United States Patent 11,098,365 (METHODS FOR SIMULTANEOUS AMPLIFICATION OF TARGET LOCI) - sequence listing, part 2

SEQ ID NO: 23984 - DNA, 19 bp, Artificial Sequence
  Synthetic Construct
aggcaggtggcctgcacaa

SEQ ID NO: 23985 - DNA, 20 bp, Artificial Sequence
  Synthetic Construct
gggaggccagattgcgaaca

SEQ ID NO: 23986 - DNA, 20 bp, Artificial Sequence
  Synthetic Construct
tccctgccttgctgggaact

SEQ ID NO: 23987 - DNA, 20 bp, Artificial Sequence
  Synthetic Construct
gacatggggcattcgcatct

SEQ ID NO: 23988 - DNA, 21 bp, Artificial Sequence
  Synthetic Construct
accctgccatcctggtgtttc

SEQ ID NO: 23989 - DNA, 20 bp, Artificial Sequence
  Synthetic Construct
aggtggcacagggctctttt

SEQ ID NO: 23990 - DNA, 21 bp, Artificial Sequence
  Synthetic Construct
ccaaagggtggatgggacagt

SEQ ID NO: 23991 - DNA, 23 bp, Artificial Sequence
  Synthetic Construct
agcaccccatcctgtgaaataac

SEQ ID NO: 23992 - DNA, 25 bp, Artificial Sequence
  Synthetic Construct
gctactctttcagtggccctacgat

SEQ ID NO: 23993 - DNA, 22 bp, Artificial Sequence
  Synthetic Construct
ctcacctgctgggtttctcttt

SEQ ID NO: 23994 - DNA, 21 bp, Artificial Sequence
  Synthetic Construct
ggggctgagtctgtgttgttg

SEQ ID NO: 23995 - DNA, 18 bp, Artificial Sequence
  Synthetic Construct
aagcgggccttggaggaa

SEQ ID NO: 23996 - DNA, 24 bp, Artificial Sequence
  Synthetic Construct
agaggcagggtatatgcaagtttc

SEQ ID NO: 23997 - DNA, 24 bp, Artificial Sequence
  Synthetic Construct
accaatggatcgttgtcttgtagt

SEQ ID NO: 23998 - DNA, 20 bp, Artificial Sequence
  Synthetic Construct
agcagcctcgggacaaaaca

SEQ ID NO: 23999 - DNA, 19 bp, Artificial Sequence
  Synthetic Construct
caccgcacccggcctataa

SEQ ID NO: 24000 - DNA, 22 bp, Artificial Sequence
  Synthetic Construct
acggtgttaggacagcatcaaa

SEQ ID NO: 24001 - DNA, 21 bp, Artificial Sequence
  Synthetic Construct
gaacctgtgtgccactgacat

SEQ ID NO: 24002 - DNA, 26 bp, Artificial Sequence
  Synthetic Construct
ggactatgggaagtcatttctgttca

SEQ ID NO: 24003 - DNA, 23 bp, Artificial Sequence
  Synthetic Construct
gctctgtgccaaatcttttgtga

SEQ ID NO: 24004 - DNA, 24 bp, Artificial Sequence
  Synthetic Construct
gctcccagtccatctgcctttatc

SEQ ID NO: 24005 - DNA, 23 bp, Artificial Sequence
  Synthetic Construct
gatcacagcgtacctcttcatgt

SEQ ID NO: 24006 - DNA, 22 bp, Artificial Sequence
  Synthetic Construct
gtgccagatgagagtcaggttt

SEQ ID NO: 24007 - DNA, 21 bp, Artificial Sequence
  Synthetic Construct
ccaactgtgtcgagcttcaga

SEQ ID NO: 24008 - DNA, 22 bp, Artificial Sequence
  Synthetic Construct
ccctcttcaccccattctttgt

SEQ ID NO: 24009 - DNA, 24 bp, Artificial Sequence
  Synthetic Construct
gtttcctctagctgctttgcattg

SEQ ID NO: 24010 - DNA, 21 bp, Artificial Sequence
  Synthetic Construct
gtggcttctctccatcagcat

SEQ ID NO: 24011 - DNA, 25 bp, Artificial Sequence
  Synthetic Construct
ctctgaaaggggttgaagcaaatgt

SEQ ID NO: 24012 - DNA, 21 bp, Artificial Sequence
  Synthetic Construct
caggtctttgcacgtggatct

SEQ ID NO: 24013 - DNA, 20 bp, Artificial Sequence
  Synthetic Construct
gccttgggacaggcatgtgt

SEQ ID NO: 24014 - DNA, 22 bp, Artificial Sequence
  Synthetic Construct
ccaaagccgctcgtactcacat

SEQ ID NO: 24015 - DNA, 22 bp, Artificial Sequence
  Synthetic Construct
gttcctcttccctgtgctgtag

SEQ ID NO: 24016 - DNA, 24 bp, Artificial Sequence
  Synthetic Construct
gcataacagtgtgggcttttcaga

SEQ ID NO: 24017 - DNA, 23 bp, Artificial Sequence
  Synthetic Construct
ggggacccatactttctctgaac

SEQ ID NO: 24018 - DNA, 23 bp, Artificial Sequence
  Synthetic Construct
gcttggaaaaccttggtgaggaa

SEQ ID NO: 24019 - DNA, 20 bp, Artificial Sequence
  Synthetic Construct
tcagcacccagtgccaatga

SEQ ID NO: 24020 - DNA, 22 bp, Artificial Sequence
  Synthetic Construct
ggtgtctgaagagccccaattc

SEQ ID NO: 24021 - DNA, 24 bp, Artificial Sequence
  Synthetic Construct
gaggagggtctgagcttctgatgt

SEQ ID NO: 24022 - DNA, 23 bp, Artificial Sequence
  Synthetic Construct
cagccctgtgtttaagcaggtaa

SEQ ID NO: 24023 - DNA, 26 bp, Artificial Sequence
  Synthetic Construct
cctgcattaactggcttctacttact

SEQ ID NO: 24024 - DNA, 27 bp, Artificial Sequence
  Synthetic Construct
gtctctcactgtagacaaggaaagcaa

SEQ ID NO: 24025 - DNA, 20 bp, Artificial Sequence
  Synthetic Construct
catgtgtcagagcccgaact

SEQ ID NO: 24026 - DNA, 26 bp, Artificial Sequence
  Synthetic Construct
caacatctgggaaaaggtacttccaa

SEQ ID NO: 24027 - DNA, 20 bp, Artificial Sequence
  Synthetic Construct
tgcagccgaggaggaatagt

SEQ ID NO: 24028 - DNA, 22 bp, Artificial Sequence
  Synthetic Construct
tgacgtccccggtgcagtaata

SEQ ID NO: 24029 - DNA, 22 bp, Artificial Sequence
  Synthetic Construct
gtaggctgggatttccctgatg

SEQ ID NO: 24030 - DNA, 19 bp, Artificial Sequence
  Synthetic Construct
aggagggaccttggagcaa

SEQ ID NO: 24031 - DNA, 22 bp, Artificial Sequence
  Synthetic Construct
ccgaggtggctgtgtattaact

SEQ ID NO: 24032 - DNA, 24 bp, Artificial Sequence
  Synthetic Construct
gtggttttctcagctgtcaagatg

SEQ ID NO: 24033 - DNA, 22 bp, Artificial Sequence
  Synthetic Construct
cagccaagaatccttccactgt

SEQ ID NO: 24034 - DNA, 21 bp, Artificial Sequence
  Synthetic Construct
gcgaggacaccaactctttct

SEQ ID NO: 24035 - DNA, 20 bp, Artificial Sequence
  Synthetic Construct
gtgactgcactccgggatga

SEQ ID NO: 24036 - DNA, 24 bp, Artificial Sequence
  Synthetic Construct
gtgtgacgggaaaaactccaggat

SEQ ID NO: 24037 - DNA, 22 bp, Artificial Sequence
  Synthetic Construct
gctcaggccaccaaaccatcta

SEQ ID NO: 24038 - DNA, 24 bp, Artificial Sequence
  Synthetic Construct
ggataaaagcgagcattctggaaa

SEQ ID NO: 24039 - DNA, 20 bp, Artificial Sequence
  Synthetic Construct
tcaggtgggtcacggcagtt

SEQ ID NO: 24040 - DNA, 22 bp, Artificial Sequence
  Synthetic Construct
gaccgtgggttcaaggaagcat

SEQ ID NO: 24041 - DNA, 25 bp, Artificial Sequence
  Synthetic Construct
gctgctgtagcccataatatactca

SEQ ID NO: 24042 - DNA, 21 bp, Artificial Sequence
  Synthetic Construct
cggggtagagacaaccgtgaa

SEQ ID NO: 24043 - DNA, 20 bp, Artificial Sequence
  Synthetic Construct
tttcctgcccaccctgctat

SEQ ID NO: 24044 - DNA, 23 bp, Artificial Sequence
  Synthetic Construct
tgggtacgactatttccggttga

SEQ ID NO: 24045 - DNA, 22 bp, Artificial Sequence
  Synthetic Construct
ccccatcagggtcaggtctctt

SEQ ID NO: 24046 - DNA, 21 bp, Artificial Sequence
  Synthetic Construct
gggcaaaagatctgcctcagt

SEQ ID NO: 24047 - DNA, 19 bp, Artificial Sequence
  Synthetic Construct
tgggaggcagagggaccaa

SEQ ID NO: 24048 - DNA, 21 bp, Artificial Sequence
  Synthetic Construct
ccacaaacaccgaccctgttc

SEQ ID NO: 24049 - DNA, 21 bp, Artificial Sequence
  Synthetic Construct
tcaggagccactggggtgaaa

SEQ ID NO: 24050 - DNA, 21 bp, Artificial Sequence
  Synthetic Construct
ctgtgcaaagggcatggaagt

SEQ ID NO: 24051 - DNA, 22 bp, Artificial Sequence
  Synthetic Construct
actctccccaggaaggaagtca

SEQ ID NO: 24052 - DNA, 22 bp, Artificial Sequence
  Synthetic Construct
cctgctcccctgtccttataga

SEQ ID NO: 24053 - DNA, 23 bp, Artificial Sequence
  Synthetic Construct
tgctcttcccctcactcaatttt

SEQ ID NO: 24054 - DNA, 21 bp, Artificial Sequence
  Synthetic Construct
gtgaggccagtgcttgtggat

SEQ ID NO: 24055 - DNA, 22 bp, Artificial Sequence
  Synthetic Construct
gccgctgaaaaccacgacattc

SEQ ID NO: 24056 - DNA, 22 bp, Artificial Sequence
  Synthetic Construct
gcagttggagccttagcagtca

SEQ ID NO: 24057 - DNA, 24 bp, Artificial Sequence
  Synthetic Construct
gcaagagggaaatggcttaagatg

SEQ ID NO: 24058 - DNA, 21 bp, Artificial Sequence
  Synthetic Construct
ccagttcagttggggcttgtt

SEQ ID NO: 24059 - DNA, 21 bp, Artificial Sequence
  Synthetic Construct
cctcttacacctggtggcaat

SEQ ID NO: 24060 - DNA, 20 bp, Artificial Sequence
  Synthetic Construct
tcatggacggcctccgtatg

SEQ ID NO: 24061 - DNA, 22 bp, Artificial Sequence
  Synthetic Construct
agcgaacttcggcaaaactttc

SEQ ID NO: 24062 - DNA, 23 bp, Artificial Sequence
  Synthetic Construct
tgcctcttccaattgaggtgaaa

SEQ ID NO: 24063 - DNA, 20 bp, Artificial Sequence
  Synthetic Construct
cacacacacgctctgtcctt

SEQ ID NO: 24064 - DNA, 22 bp, Artificial Sequence
  Synthetic Construct
ggccaggggaagtacaggtaga

SEQ ID NO: 24065 - DNA, 23 bp, Artificial Sequence
  Synthetic Construct
gctgccaatgtcctgaagccata

SEQ ID NO: 24066 - DNA, 21 bp, Artificial Sequence
  Synthetic Construct
cctgctagaagccgtggctaa

SEQ ID NO: 24067 - DNA, 24 bp, Artificial Sequence
  Synthetic Construct
gtagttttccttgtggagggctaa

SEQ ID NO: 24068 - DNA, 24 bp, Artificial Sequence
  Synthetic Construct
gagcacacccctaccaaaaggaaa

SEQ ID NO: 24069 - DNA, 21 bp, Artificial Sequence
  Synthetic Construct
tccctgaagagggccaaggat

SEQ ID NO: 24070 - DNA, 26 bp, Artificial Sequence
  Synthetic Construct
ggaaataaatggcctgttaggctgaa

SEQ ID NO: 24071 - DNA, 23 bp, Artificial Sequence
  Synthetic Construct
gctccgtgtttccacagaacctt

SEQ ID NO: 24072 - DNA, 20 bp, Artificial Sequence
  Synthetic Construct
ggcagcaacgtcagggaaaa

SEQ ID NO: 24073 - DNA, 23 bp, Artificial Sequence
  Synthetic Construct
tgccagtacagtgcaattggaaa

SEQ ID NO: 24074 - DNA, 24 bp, Artificial Sequence
  Synthetic Construct
gacgtgaagttgcccatagctaca

SEQ ID NO: 24075 - DNA, 23 bp, Artificial Sequence
  Synthetic Construct
ggcgaagaaggaatggagtgtga

SEQ ID NO: 24076 - DNA, 22 bp, Artificial Sequence
  Synthetic Construct
ccagctcacagactcctgtaac

SEQ ID NO: 24077 - DNA, 25 bp, Artificial Sequence
  Synthetic Construct
caaggtaggatcttccctcttgtgt

SEQ ID NO: 24078 - DNA, 20 bp, Artificial Sequence
  Synthetic Construct
tcttgcttccccacctcagt

SEQ ID NO: 24079 - DNA, 22 bp, Artificial Sequence
  Synthetic Construct
cggagcagtggcaatggaaatc

SEQ ID NO: 24080 - DNA, 22 bp, Artificial Sequence
  Synthetic Construct
cctccttggggaaccacaaact

SEQ ID NO: 24081 - DNA, 22 bp, Artificial Sequence
  Synthetic Construct
ggggctgacaacatgactgctt

SEQ ID NO: 24082 - DNA, 23 bp, Artificial Sequence
  Synthetic Construct
ctatggacctgttccaaccacat

SEQ ID NO: 24083 - DNA, 22 bp, Artificial Sequence
  Synthetic Construct
gcaggactaaagccacaggtaa

SEQ ID NO: 24084 - DNA, 23 bp, Artificial Sequence
  Synthetic Construct
cagataagtgtgctcagctctca

SEQ ID NO: 24085 - DNA, 22 bp, Artificial Sequence
  Synthetic Construct
gtgccagccagtgtgctaaatc

SEQ ID NO: 24086 - DNA, 21 bp, Artificial Sequence
  Synthetic Construct
cctaagcaacaggcagctctt

SEQ ID NO: 24087 - DNA, 19 bp, Artificial Sequence
  Synthetic Construct
aggctgctgcctccacact

SEQ ID NO: 24088 - DNA, 25 bp, Artificial Sequence
  Synthetic Construct
aggagggaagaggattatgcttcta

SEQ ID NO: 24089 - DNA, 26 bp, Artificial Sequence
  Synthetic Construct
gtggaggtattttcaagctcaacttc

SEQ ID NO: 24090 - DNA, 26 bp, Artificial Sequence
  Synthetic Construct
ccagacatctaagcgattttggaagt

SEQ ID NO: 24091 - DNA, 23 bp, Artificial Sequence
  Synthetic Construct
gtgtggttctggaaaggagtgat

SEQ ID NO: 24092 - DNA, 23 bp, Artificial Sequence
  Synthetic Construct
tgttgactccaggtgcaaaatct

SEQ ID NO: 24093 - DNA, 20 bp, Artificial Sequence
  Synthetic Construct
acccgtgtggctggagaaac

SEQ ID NO: 24094 - DNA, 24 bp, Artificial Sequence
  Synthetic Construct
tcttgccttcatgcagctcaaata

SEQ ID NO: 24095 - DNA, 24 bp, Artificial Sequence
  Synthetic Construct
cagcagcatccaatccaaccatca

SEQ ID NO: 24096 - DNA, 25 bp, Artificial Sequence
  Synthetic Construct
gaattggctcactaggctagaatgt

SEQ ID NO: 24097 - DNA, 22 bp, Artificial Sequence
  Synthetic Construct
gtcctcgtcctgagcagatgtt

SEQ ID NO: 24098 - DNA, 22 bp, Artificial Sequence
  Synthetic Construct
tgccaaaagttatggggtgcta

SEQ ID NO: 24099 - DNA, 21 bp, Artificial Sequence
  Synthetic Construct
ccaccatccagtgcctgttga

SEQ ID NO: 24100 - DNA, 21 bp, Artificial Sequence
  Synthetic Construct
ggccatgctggatgatagcaa

SEQ ID NO: 24101 - DNA, 24 bp, Artificial Sequence
  Synthetic Construct
tccacgtttcagattgtcgagtta

SEQ ID NO: 24102 - DNA, 24 bp, Artificial Sequence
  Synthetic Construct
gctgtgtacgtggagctttgacta

SEQ ID NO: 24103 - DNA, 22 bp, Artificial Sequence
  Synthetic Construct
tccgggatggaacaatggtact

SEQ ID NO: 24104 - DNA, 22 bp, Artificial Sequence
  Synthetic Construct
cgtccctcacacttcacagcat

SEQ ID NO: 24105 - DNA, 23 bp, Artificial Sequence
  Synthetic Construct
ccctgtgccctctaagcctacaa

SEQ ID NO: 24106 - DNA, 22 bp, Artificial Sequence
  Synthetic Construct
ctgcccactgtaacgcattttc

SEQ ID NO: 24107 - DNA, 24 bp, Artificial Sequence
  Synthetic Construct
cgagaaacctttgcaagtgagtga

SEQ ID NO: 24108 - DNA, 20 bp, Artificial Sequence
  Synthetic Construct
ccacctccacagcctcatct

SEQ ID NO: 24109 - DNA, 22 bp, Artificial Sequence
  Synthetic Construct
cccatggccagcattacctctt

SEQ ID NO: 24110 - DNA, 22 bp, Artificial Sequence
  Synthetic Construct
cagcccagattccatgcctgtt

SEQ ID NO: 24111 - DNA, 22 bp, Artificial Sequence
  Synthetic Construct
cagtggtcaaagctggggaaac

SEQ ID NO: 24112 - DNA, 20 bp, Artificial Sequence
  Synthetic Construct
tggccctcctgctcctggat

SEQ ID NO: 24113 - DNA, 23 bp, Artificial Sequence
  Synthetic Construct
gttgccctgggactcaaagatag

SEQ ID NO: 24114 - DNA, 26 bp, Artificial Sequence
  Synthetic Construct
gtgcaggaaccccatctatatgtgaa

SEQ ID NO: 24115 - DNA, 22 bp, Artificial Sequence
  Synthetic Construct
tccagagggttgacaggtcagt

SEQ ID NO: 24116 - DNA, 25 bp, Artificial Sequence
  Synthetic Construct
gctgcatgtttactcactttccttt

SEQ ID NO: 24117 - DNA, 22 bp, Artificial Sequence
  Synthetic Construct
aatttcgtggagcctcaggttt

SEQ ID NO: 24118 - DNA, 20 bp, Artificial Sequence
  Synthetic Construct
caagtgctcgctctgcattg

SEQ ID NO: 24119 - DNA, 21 bp, Artificial Sequence
  Synthetic Construct
tccaacacagcgtgtttctca

SEQ ID NO: 24120 - DNA, 20 bp, Artificial Sequence
  Synthetic Construct
ggggtggggcatgagagatt

SEQ ID NO: 24121 - DNA, 21 bp, Artificial Sequence
  Synthetic Construct
acaggggtaaagggaggctaa

SEQ ID NO: 24122 - DNA, 24 bp, Artificial Sequence
  Synthetic Construct
gcccaaaacacagtgtgacaagta

SEQ ID NO: 24123 - DNA, 21 bp, Artificial Sequence
  Synthetic Construct
tgtttgcctcagcgactcttg

SEQ ID NO: 24124 - DNA, 23 bp, Artificial Sequence
  Synthetic Construct
tgctcaatgtctatgccagaact

SEQ ID NO: 24125 - DNA, 22 bp, Artificial Sequence
  Synthetic Construct
gtccctggggacataggtgaca

SEQ ID NO: 24126 - DNA, 22 bp, Artificial Sequence
  Synthetic Construct
ctggagagagaggcccttggaa

SEQ ID NO: 24127 - DNA, 21 bp, Artificial Sequence
  Synthetic Construct
caccctgagatcatggcactt

SEQ ID NO: 24128 - DNA, 23 bp, Artificial Sequence
  Synthetic Construct
aggtcagaggagccatctttttg

SEQ ID NO: 24129 - DNA, 24 bp, Artificial Sequence
  Synthetic Construct
cttgactgacagccattccctatg

SEQ ID NO: 24130 - DNA, 21 bp, Artificial Sequence
  Synthetic Construct
ggttgcatgcctcacatccat

SEQ ID NO: 24131 - DNA, 22 bp, Artificial Sequence
  Synthetic Construct
tggagaggagttgcaagggtaa

SEQ ID NO: 24132 - DNA, 24 bp, Artificial Sequence
  Synthetic Construct
ctgcttcttcatctaagcgggaaa

SEQ ID NO: 24133 - DNA, 20 bp, Artificial Sequence
  Synthetic Construct
acaaggacgcttcgcggaaa

SEQ ID NO: 24134 - DNA, 25 bp, Artificial Sequence
  Synthetic Construct
gcaggaatgtcatggaggttactct

SEQ ID NO: 24135 - DNA, 24 bp, Artificial Sequence
  Synthetic Construct
cagcctgataacattggggtgtag

SEQ ID NO: 24136 - DNA, 19 bp, Artificial Sequence
  Synthetic Construct
gcttgggacccaggtgaga

SEQ ID NO: 24137 - DNA, 23 bp, Artificial Sequence
  Synthetic Construct
cggcaatttaggacccaaaacaa

SEQ ID NO: 24138 - DNA, 25 bp, Artificial Sequence
  Synthetic Construct
gcgtgagatgtctggatgtgaccta

SEQ ID NO: 24139 - DNA, 27 bp, Artificial Sequence
  Synthetic Construct
gtgggttctataggactaagccagatg

SEQ ID NO: 24140 - DNA, 27 bp, Artificial Sequence
  Synthetic Construct
actaaagaccttgtgaaggaggtaatg

SEQ ID NO: 24141 - DNA, 22 bp, Artificial Sequence
  Synthetic Construct
tgccttctgtggctgtagtgta

SEQ ID NO: 24142 - DNA, 20 bp, Artificial Sequence
  Synthetic Construct
acccgtggcttcaccatttg

SEQ ID NO: 24143 - DNA, 20 bp, Artificial Sequence
  Synthetic Construct
ttatcaccgccccgcaaaag

SEQ ID NO: 24144 - DNA, 20 bp, Artificial Sequence
  Synthetic Construct
accgcaagcagtcctacaac

SEQ ID NO: 24145 - DNA, 21 bp, Artificial Sequence
  Synthetic Construct
agtggcctagcttccttgtga

SEQ ID NO: 24146 - DNA, 18 bp, Artificial Sequence
  Synthetic Construct
aacccggccctgctttga

SEQ ID NO: 24147 - DNA, 22 bp, Artificial Sequence
  Synthetic Construct
ctaaggtgcacgggattaggtt

SEQ ID NO: 24148 - DNA, 27 bp, Artificial Sequence
  Synthetic Construct
ggcaacagctactatttttccctcaac

SEQ ID NO: 24149 - DNA, 20 bp, Artificial Sequence
  Synthetic Construct
ctggaggcactttcccaaca

SEQ ID NO: 24150 - DNA, 22 bp, Artificial Sequence
  Synthetic Construct
cgtgcttcctcctccctttctt

SEQ ID NO: 24151 - DNA, 19 bp, Artificial Sequence
  Synthetic Construct
cagcagtgcgctgggaaac

SEQ ID NO: 24152 - DNA, 20 bp, Artificial Sequence
  Synthetic Construct
cacctgggtccagcctcaag

SEQ ID NO: 24153 - DNA, 20 bp, Artificial Sequence
  Synthetic Construct
cctctggcctggaagacact

SEQ ID NO: 24154 - DNA, 19 bp, Artificial Sequence
  Synthetic Construct
ccctccagccttcgccttt

SEQ ID NO: 24155 - DNA, 23 bp, Artificial Sequence
  Synthetic Construct
cctccccagccagaagatcacat

SEQ ID NO: 24156 - DNA, 20 bp, Artificial Sequence
  Synthetic Construct
tgtgcatgccatctcctgtt

SEQ ID NO: 24157 - DNA, 20 bp, Artificial Sequence
  Synthetic Construct
aaaccgatggacggcgcatt

SEQ ID NO: 24158 - DNA, 18 bp, Artificial Sequence
  Synthetic Construct
tcccagggtgctgtcctt

SEQ ID NO: 24159 - DNA, 24 bp, Artificial Sequence
  Synthetic Construct
ccctagcctccttttctcaaagtt

SEQ ID NO: 24160 - DNA, 22 bp, Artificial Sequence
  Synthetic Construct
tcttgtgtgtaagcccctcctt

SEQ ID NO: 24161 - DNA, 21 bp, Artificial Sequence
  Synthetic Construct
tggggagctgaggaggcattt

SEQ ID NO: 24162 - DNA, 20 bp, Artificial Sequence
  Synthetic Construct
tcaggccactctcccaaaga

SEQ ID NO: 24163 - DNA, 19 bp, Artificial Sequence
  Synthetic Construct
ccagctgccacagaactga

SEQ ID NO: 24164 - DNA, 20 bp, Artificial Sequence
  Synthetic Construct
actctgtgccgtctgtcaac

SEQ ID NO: 24165 - DNA, 23 bp, Artificial Sequence
  Synthetic Construct
gcagatcctctccacctagagtt

SEQ ID NO: 24166 - DNA, 23 bp, Artificial Sequence
  Synthetic Construct
ctcattgcccctgttgctgattc

SEQ ID NO: 24167 - DNA, 23 bp, Artificial Sequence
  Synthetic Construct
gcccaggtcaggtaagtagagat

SEQ ID NO: 24168 - DNA, 23 bp, Artificial Sequence
  Synthetic Construct
acacccaattccttgttcctcaa

SEQ ID NO: 24169 - DNA, 25 bp, Artificial Sequence
  Synthetic Construct
gaagaaatgctgtgccattgaactt

SEQ ID NO: 24170 - DNA, 21 bp, Artificial Sequence
  Synthetic Construct
ccggtaccagctggaatcaat

SEQ ID NO: 24171 - DNA, 22 bp, Artificial Sequence
  Synthetic Construct
gtgaggaccccactcgtttatg

SEQ ID NO: 24172 - DNA, 21 bp, Artificial Sequence
  Synthetic Construct
agccagctgctaagttgctaa

SEQ ID NO: 24173 - DNA, 24 bp, Artificial Sequence
  Synthetic Construct
gatctgggcctgatgaagaagcta

SEQ ID NO: 24174 - DNA, 22 bp, Artificial Sequence
  Synthetic Construct
gccagtgtggctagagagcaat

SEQ ID NO: 24175 - DNA, 21 bp, Artificial Sequence
  Synthetic Construct
ccttggcattgacgaccttct

SEQ ID NO: 24176 - DNA, 24 bp, Artificial Sequence
  Synthetic Construct
ttgtgtgacctcaagctaatcact

SEQ ID NO: 24177 - DNA, 23 bp, Artificial Sequence
  Synthetic Construct
tgccttggtccgtaacaattaca

SEQ ID NO: 24178 - DNA, 20 bp, Artificial Sequence
  Synthetic Construct
tggatggacagagggtgtgt

SEQ ID NO: 24179 - DNA, 18 bp, Artificial Sequence
  Synthetic Construct
tgtcgggtgccacaccat

SEQ ID NO: 24180 - DNA, 21 bp, Artificial Sequence
  Synthetic Construct
atgttcatgccgtcagactgt

SEQ ID NO: 24181 - DNA, 28 bp, Artificial Sequence
  Synthetic Construct
gagtaagtgggctcatcaaactatgctt

SEQ ID NO: 24182 - DNA, 25 bp, Artificial Sequence
  Synthetic Construct
ggtatgaatcccaccgttgaacaca

SEQ ID NO: 24183 - DNA, 21 bp, Artificial Sequence
  Synthetic Construct
ctagttccctcagcccagttg

SEQ ID NO: 24184 - DNA, 22 bp, Artificial Sequence
  Synthetic Construct
ggagtttagagcccctgccaaa

SEQ ID NO: 24185 - DNA, 20 bp, Artificial Sequence
  Synthetic Construct
tggagctacagcgtccatct

SEQ ID NO: 24186 - DNA, 24 bp, Artificial Sequence
  Synthetic Construct
cctggcttccttgtatcctgatct

SEQ ID NO: 24187 - DNA, 21 bp, Artificial Sequence
  Synthetic Construct
agcagcacatggctttcatct

SEQ ID NO: 24188 - DNA, 21 bp, Artificial Sequence
  Synthetic Construct
acgctgagcacacagttcatc

SEQ ID NO: 24189 - DNA, 21 bp, Artificial Sequence
  Synthetic Construct
gccagccgtgctactgatgtt

SEQ ID NO: 24190 - DNA, 21 bp, Artificial Sequence
  Synthetic Construct
ggggtgttggtgttgtaggaa

SEQ ID NO: 24191 - DNA, 25 bp, Artificial Sequence
  Synthetic Construct
gtgtcagctaccagactcctttttc

SEQ ID NO: 24192 - DNA, 21 bp, Artificial Sequence
  Synthetic Construct
gctgctaccctgcaagtcagt

SEQ ID NO: 24193 - DNA, 22 bp, Artificial Sequence
  Synthetic Construct
ggaaagggtgctagctttgaca

SEQ ID NO: 24194 - DNA, 27 bp, Artificial Sequence
  Synthetic Construct
catccagcttcactgactcagaatctt

SEQ ID NO: 24195 - DNA, 26 bp, Artificial Sequence
  Synthetic Construct
gcaatgtgcttggacttatgttggat

SEQ ID NO: 24196 - DNA, 21 bp, Artificial Sequence
  Synthetic Construct
tgaggaagtgggcgtctcttg

SEQ ID NO: 24197 - DNA, 21 bp, Artificial Sequence
  Synthetic Construct
acaatggggctagatgcacaa

SEQ ID NO: 24198 - DNA, 24 bp, Artificial Sequence
  Synthetic Construct
agacttcccagtgacaaccataga

SEQ ID NO: 24199 - DNA, 23 bp, Artificial Sequence
  Synthetic Construct
cctggaactgggtttctttgaac

SEQ ID NO: 24200 - DNA, 24 bp, Artificial Sequence
  Synthetic Construct
agcctagtagccactgaaactaga

SEQ ID NO: 24201 - DNA, 21 bp, Artificial Sequence
  Synthetic Construct
tctggcacatgttgagtgctt

SEQ ID NO: 24202 - DNA, 22 bp, Artificial Sequence
  Synthetic Construct
cagatcttctcctgccccaaca

SEQ ID NO: 24203 - DNA, 20 bp, Artificial Sequence
  Synthetic Construct
gggctggggttggagagaag

SEQ ID NO: 24204 - DNA, 24 bp, Artificial Sequence
  Synthetic Construct
cctttgacgtctagcatcctatgt

SEQ ID NO: 24205 - DNA, 22 bp, Artificial Sequence
  Synthetic Construct
ccccaacaccctagagcctttt

SEQ ID NO: 24206 - DNA, 22 bp, Artificial Sequence
  Synthetic Construct
gcaggtggggtaaggtctctga

SEQ ID NO: 24207 - DNA, 18 bp, Artificial Sequence
  Synthetic Construct
ttgcccctcctggtgagt

SEQ ID NO: 24208 - DNA, 21 bp, Artificial Sequence
  Synthetic Construct
ttctcctgaggctgactggaa

SEQ ID NO: 24209 - DNA, 21 bp, Artificial Sequence
  Synthetic Construct
cccctcttgcctgggaataca

SEQ ID NO: 24210 - DNA, 22 bp, Artificial Sequence
  Synthetic Construct
gccaaggattgggtctgtgtga

SEQ ID NO: 24211 - DNA, 21 bp, Artificial Sequence
  Synthetic Construct
agcagccctcaacctggaaga

SEQ ID NO: 24212 - DNA, 26 bp, Artificial Sequence
  Synthetic Construct
ctcttttctcttgggctgatcagttt

SEQ ID NO: 24213 - DNA, 22 bp, Artificial Sequence
  Synthetic Construct
agagtctgacctccctttcaca

SEQ ID NO: 24214 - DNA, 24 bp, Artificial Sequence
  Synthetic Construct
cccatggggcttaactttgactga

SEQ ID NO: 24215 - DNA, 23 bp, Artificial Sequence
  Synthetic Construct
cacaagctgactgaagagtcctt

SEQ ID NO: 24216 - DNA, 22 bp, Artificial Sequence
  Synthetic Construct
ccctgtcatgcgcaaggtgtta

SEQ ID NO: 24217 - DNA, 20 bp, Artificial Sequence
  Synthetic Construct
aggaacctgggcccttgaat

SEQ ID NO: 24218 - DNA, 22 bp, Artificial Sequence
  Synthetic Construct
gctatggggtgggaagacaagt

SEQ ID NO: 24219 - DNA, 19 bp, Artificial Sequence
  Synthetic Construct
ggcccaggtcctgaacgaa

SEQ ID NO: 24220 - DNA, 23 bp, Artificial Sequence
  Synthetic Construct
actgacaggttttgctgatggat

SEQ ID NO: 24221 - DNA, 20 bp, Artificial Sequence
  Synthetic Construct
acgtggttgcaagctactga

SEQ ID NO: 24222 - DNA, 20 bp, Artificial Sequence
  Synthetic Construct
agcgctgggtgtaggatgtt

SEQ ID NO: 24223 - DNA, 20 bp, Artificial Sequence
  Synthetic Construct
ctgcctcaccgaagcattca

SEQ ID NO: 24224 - DNA, 23 bp, Artificial Sequence
  Synthetic Construct
gcatgttccctgaattgccttac

SEQ ID NO: 24225 - DNA, 19 bp, Artificial Sequence
  Synthetic Construct
tgaggctgagggtgcaaca

SEQ ID NO: 24226 - DNA, 25 bp, Artificial Sequence
  Synthetic Construct
gagctacaaaatggaaggagactga

SEQ ID NO: 24227 - DNA, 21 bp, Artificial Sequence
  Synthetic Construct
accagggaggaggcttgtgtt

SEQ ID NO: 24228 - DNA, 25 bp, Artificial Sequence
  Synthetic Construct
gcccacagttatccttgactctctt

SEQ ID NO: 24229 - DNA, 25 bp, Artificial Sequence
  Synthetic Construct
ggctgaccattaggttttactgtga

SEQ ID NO: 24230 - DNA, 19 bp, Artificial Sequence
  Synthetic Construct
agcacgggcagcagcagaa

SEQ ID NO: 24231 - DNA, 23 bp, Artificial Sequence
  Synthetic Construct
cctggtgcacactaggaataaca

SEQ ID NO: 24232 - DNA, 22 bp, Artificial Sequence
  Synthetic Construct
ccctcagctacatgccgagaaa

SEQ ID NO: 24233 - DNA, 20 bp, Artificial Sequence
  Synthetic Construct
agcaggcggatgtcaaggaa

SEQ ID NO: 24234 - DNA, 19 bp, Artificial Sequence
  Synthetic Construct
tgggtctctggcctcactt

SEQ ID NO: 24235 - DNA, 21 bp, Artificial Sequence
  Synthetic Construct
ggtcacctgtgcctaggagtt

SEQ ID NO: 24236 - DNA, 24 bp, Artificial Sequence
  Synthetic Construct
gtctaggggcggttaggatacact

SEQ ID NO: 24237 - DNA, 22 bp, Artificial Sequence
  Synthetic Construct
ggaacggggtggaactttcctt

SEQ ID NO: 24238 - DNA, 20 bp, Artificial Sequence
  Synthetic Construct
agccaggcagcaagcatgaa

SEQ ID NO: 24239 - DNA, 21 bp, Artificial Sequence
  Synthetic Construct
ggcatagcgtggtgaatgact

SEQ ID NO: 24240 - DNA, 24 bp, Artificial Sequence
  Synthetic Construct
gagcaactcagactcatggagcaa

SEQ ID NO: 24241 - DNA, 20 bp, Artificial Sequence
  Synthetic Construct
caccagcgggagcatcatta

SEQ ID NO: 24242 - DNA, 20 bp, Artificial Sequence
  Synthetic Construct
cccggcaaagcctccctaat

SEQ ID NO: 24243 - DNA, 24 bp, Artificial Sequence
  Synthetic Construct
gagtctgagccaaaatccttcact

SEQ ID NO: 24244 - DNA, 24 bp, Artificial Sequence
  Synthetic Construct
actgaaaaggcggttgcttataga

SEQ ID NO: 24245 - DNA, 22 bp, Artificial Sequence
  Synthetic Construct
tgtaggcagggtggtcgtgata

SEQ ID NO: 24246 - DNA, 24 bp, Artificial Sequence
  Synthetic Construct
gcacaatcgataggcacaccacat

SEQ ID NO: 24247 - DNA, 22 bp, Artificial Sequence
  Synthetic Construct
gcgtctgtgggactaacctctt

SEQ ID NO: 24248 - DNA, 20 bp, Artificial Sequence
  Synthetic Construct
acatgaggggcagcttcact

SEQ ID NO: 24249 - DNA, 20 bp, Artificial Sequence
  Synthetic Construct
agggtatgcctgagcacaca

SEQ ID NO: 24250 - DNA, 20 bp, Artificial Sequence
  Synthetic Construct
gccctccagctccccatatc

SEQ ID NO: 24251 - DNA, 23 bp, Artificial Sequence
  Synthetic Construct
ggcttccacacaggaaatagtgt

SEQ ID NO: 24252 - DNA, 24 bp, Artificial Sequence
  Synthetic Construct
gggtgaggttgtgggaagcataag

SEQ ID NO: 24253 - DNA, 22 bp, Artificial Sequence
  Synthetic Construct
gctcgcaggcaccctttattga

SEQ ID NO: 24254 - DNA, 23 bp, Artificial Sequence
  Synthetic Construct
cctgctcccggatacacagaaac

SEQ ID NO: 24255 - DNA, 25 bp, Artificial Sequence
  Synthetic Construct
gggattcttcctgaaattggctttg

SEQ ID NO: 24256 - DNA, 22 bp, Artificial Sequence
  Synthetic Construct
ggcagaagccgagtcaatctct

SEQ ID NO: 24257 - DNA, 19 bp, Artificial Sequence
  Synthetic Construct
acatgcggcttcgggtgtt

SEQ ID NO: 24258 - DNA, 20 bp, Artificial Sequence
  Synthetic Construct
agacagcggccaggttgaat

SEQ ID NO: 24259 - DNA, 24 bp, Artificial Sequence
  Synthetic Construct
ccaggaagcttctcaaagtcaaga

SEQ ID NO: 24260 - DNA, 18 bp, Artificial Sequence
  Synthetic Construct
tgcttccttgcgcacaca

SEQ ID NO: 24261 - DNA, 24 bp, Artificial Sequence
  Synthetic Construct
cctaagacatgtccccaggaaaaa

SEQ ID NO: 24262 - DNA, 21 bp, Artificial Sequence
  Synthetic Construct
acagcctggagaccctgaaca

SEQ ID NO: 24263 - DNA, 23 bp, Artificial Sequence
  Synthetic Construct
ccttcgaaacccagacgatctca

SEQ ID NO: 24264 - DNA, 25 bp, Artificial Sequence
  Synthetic Construct
gactaggacctctgctaggattgta

SEQ ID NO: 24265 - DNA, 20 bp, Artificial Sequence
  Synthetic Construct
ttccctccggggtcatggtt

SEQ ID NO: 24266 - DNA, 20 bp, Artificial Sequence
  Synthetic Construct
ctgcacccagcccaaatgat

SEQ ID NO: 24267 - DNA, 23 bp, Artificial Sequence
  Synthetic Construct
gctgggcaattcacgaggttttc

SEQ ID NO: 24268 - DNA, 24 bp, Artificial Sequence
  Synthetic Construct
gtgatttttaaggccagcaccaat

SEQ ID NO: 24269 - DNA, 23 bp, Artificial Sequence
  Synthetic Construct
ggcagatagtgccaagagaggtt

SEQ ID NO: 24270 - DNA, 24 bp, Artificial Sequence
  Synthetic Construct
atgttagtgtgctgtttccagaga

SEQ ID NO: 24271 - DNA, 21 bp, Artificial Sequence
  Synthetic Construct
tccagggccttctggtcatgt

SEQ ID NO: 24272 - DNA, 20 bp, Artificial Sequence
  Synthetic Construct
tgctgctggggcatgaataa

SEQ ID NO: 24273 - DNA, 26 bp, Artificial Sequence
  Synthetic Construct
gtgtcctcggtgtcaatacataacat

SEQ ID NO: 24274 - DNA, 20 bp, Artificial Sequence
  Synthetic Construct
aagcgccagccgacactgat

SEQ ID NO: 24275 - DNA, 25 bp, Artificial Sequence
  Synthetic Construct
ggggaggaaagagtgagctgtaaaa

SEQ ID NO: 24276 - DNA, 22 bp, Artificial Sequence
  Synthetic Construct
cctgccatacagcactgacaga

SEQ ID NO: 24277 - DNA, 19 bp, Artificial Sequence
  Synthetic Construct
tgcagagcccaggacaaag

SEQ ID NO: 24278 - DNA, 21 bp, Artificial Sequence
  Synthetic Construct
ccctccagcactttggaggaa

SEQ ID NO: 24279 - DNA, 21 bp, Artificial Sequence
  Synthetic Construct
aggagacagtggccctattca

SEQ ID NO: 24280 - DNA, 22 bp, Artificial Sequence
  Synthetic Construct
ccttctcaaggccactgagcta

SEQ ID NO: 24281 - DNA, 21 bp, Artificial Sequence
  Synthetic Construct
tcccacatctggggacagcat

SEQ ID NO: 24282 - DNA, 22 bp, Artificial Sequence
  Synthetic Construct
cccaagctcctcctccttgaaa

SEQ ID NO: 24283 - DNA, 22 bp, Artificial Sequence
  Synthetic Construct
cctctgcttctctccagcttca

SEQ ID NO: 24284 - DNA, 22 bp, Artificial Sequence
  Synthetic Construct
gggagaaggggtggatcaagaa

SEQ ID NO: 24285 - DNA, 22 bp, Artificial Sequence
  Synthetic Construct
gtctttcagctcagccacaatg

SEQ ID NO: 24286 - DNA, 19 bp, Artificial Sequence
  Synthetic Construct
tggaggcgtacccaactgt

SEQ ID NO: 24287 - DNA, 20 bp, Artificial Sequence
  Synthetic Construct
gcctgcctaccagtctgtct

SEQ ID NO: 24288 - DNA, 24 bp, Artificial Sequence
  Synthetic Construct
gtgacttgtaggcattggtgtcaa

SEQ ID NO: 24289 - DNA, 26 bp, Artificial Sequence
  Synthetic Construct
cctttgtataccagttccttctgcat

SEQ ID NO: 24290 - DNA, 20 bp, Artificial Sequence
  Synthetic Construct
actcagcctcacaggtgttg

SEQ ID NO: 24291 - DNA, 21 bp, Artificial Sequence
  Synthetic Construct
ccagcagatcctgccatcctt

SEQ ID NO: 24292 - DNA, 27 bp, Artificial Sequence
  Synthetic Construct
aggagctaaaacactctttaccagatg

SEQ ID NO: 24293 - DNA, 20 bp, Artificial Sequence
  Synthetic Construct
actgcaacaagggcaaggaa

SEQ ID NO: 24294 - DNA, 23 bp, Artificial Sequence
  Synthetic Construct
gcatgaatcacgcttgttgtact

SEQ ID NO: 24295 - DNA, 19 bp, Artificial Sequence
  Synthetic Construct
agccagctgcagttccaaa

SEQ ID NO: 24296 - DNA, 25 bp, Artificial Sequence
  Synthetic Construct
caggctacagaaagcatttacaaca

SEQ ID NO: 24297 - DNA, 24 bp, Artificial Sequence
  Synthetic Construct
ggcaagtgggcacttatccagtag

SEQ ID NO: 24298 - DNA, 22 bp, Artificial Sequence
  Synthetic Construct
cccctaagggtgaatgcagaat

SEQ ID NO: 24299 - DNA, 25 bp, Artificial Sequence
  Synthetic Construct
ccactaaacccacagaacccagaga

SEQ ID NO: 24300 - DNA, 23 bp, Artificial Sequence
  Synthetic Construct
cagccagaccatctgtggaacaa

SEQ ID NO: 24301 - DNA, 25 bp, Artificial Sequence
  Synthetic Construct
caggtgtgcatggagatgtttgaag

SEQ ID NO: 24302 - DNA, 22 bp, Artificial Sequence
  Synthetic Construct
gaggatggggcaggtcaaagaa

SEQ ID NO: 24303 - DNA, 18 bp, Artificial Sequence
  Synthetic Construct
atcacgtggctgctgctt

SEQ ID NO: 24304 - DNA, 22 bp, Artificial Sequence
  Synthetic Construct
ccaccctccaggtgtttgcttt

SEQ ID NO: 24305 - DNA, 21 bp, Artificial Sequence
  Synthetic Construct
atcagtgttggcgtctccttt

SEQ ID NO: 24306 - DNA, 22 bp, Artificial Sequence
  Synthetic Construct
gaggcctgagaaactcgtgatg

SEQ ID NO: 24307 - DNA, 21 bp, Artificial Sequence
  Synthetic Construct
gcctcatgtgaggggcttttc

SEQ ID NO: 24308 - DNA, 23 bp, Artificial Sequence
  Synthetic Construct
tctactgctcccaccttagtcaa

SEQ ID NO: 24309 - DNA, 21 bp, Artificial Sequence
  Synthetic Construct
gcagccactgatgcgaagaac

SEQ ID NO: 24310 - DNA, 22 bp, Artificial Sequence
  Synthetic Construct
cccttcaggtggtcctgttttg

SEQ ID NO: 24311 - DNA, 19 bp, Artificial Sequence
  Synthetic Construct
ggctggggttcaggccata

SEQ ID NO: 24312 - DNA, 20 bp, Artificial Sequence
  Synthetic Construct
aggcccggaaaaagcacagt

SEQ ID NO: 24313 - DNA, 20 bp, Artificial Sequence
  Synthetic Construct
tgagtgcccaacggcaagaa

SEQ ID NO: 24314 - DNA, 22 bp, Artificial Sequence
  Synthetic Construct
tggggactgccctataatgtct

SEQ ID NO: 24315 - DNA, 22 bp, Artificial Sequence
  Synthetic Construct
ggctggaacagcaagtctgcta

SEQ ID NO: 24316 - DNA, 23 bp, Artificial Sequence
  Synthetic Construct
accaccaatcctaggcaacttac

SEQ ID NO: 24317 - DNA, 22 bp, Artificial Sequence
  Synthetic Construct
cacaggggaggtttcctggtta

SEQ ID NO: 24318 - DNA, 21 bp, Artificial Sequence
  Synthetic Construct
ccctctcaccagctcctctct

SEQ ID NO: 24319 - DNA, 20 bp, Artificial Sequence
  Synthetic Construct
caccacagagcccaagaaca

SEQ ID NO: 24320 - DNA, 21 bp, Artificial Sequence
  Synthetic Construct
gtggaaattgcctgcgtgtct

SEQ ID NO: 24321 - DNA, 20 bp, Artificial Sequence
  Synthetic Construct
tcatgttggccggtggaaat

SEQ ID NO: 24322 - DNA, 22 bp, Artificial Sequence
  Synthetic Construct
gtgcagccacagtaatgctttt

SEQ ID NO: 24323 - DNA, 20 bp, Artificial Sequence
  Synthetic Construct
aacgggtcctgagaccaaac

SEQ ID NO: 24324 - DNA, 25 bp, Artificial Sequence
  Synthetic Construct
cctgagcaattcccaacctcctctt

SEQ ID NO: 24325 - DNA, 23 bp, Artificial Sequence
  Synthetic Construct
ttcactctccctcctgtgtagaa

SEQ ID NO: 24326 - DNA, 20 bp, Artificial Sequence
  Synthetic Construct
ggtccctggcacgtacttct

SEQ ID NO: 24327 - DNA, 22 bp, Artificial Sequence
  Synthetic Construct
tagcaggaacagtggcgtgtca

SEQ ID NO: 24328 - DNA, 22 bp, Artificial Sequence
  Synthetic Construct
ggcttaggtgggaggatcactt

SEQ ID NO: 24329 - DNA, 22 bp, Artificial Sequence
  Synthetic Construct
acgcagagacccacagcaatac

SEQ ID NO: 24330 - DNA, 25 bp, Artificial Sequence
  Synthetic Construct
tgcttctcccattttccatttcctt

SEQ ID NO: 24331 - DNA, 21 bp, Artificial Sequence
  Synthetic Construct
gttcccagaactggtgtggtt

SEQ ID NO: 24332 - DNA, 25 bp, Artificial Sequence
  Synthetic Construct
tctgaagctcacatggattccttag

SEQ ID NO: 24333 - DNA, 24 bp, Artificial Sequence
  Synthetic Construct
agttttgtcagaggtgttgagtga

SEQ ID NO: 24334 - DNA, 20 bp, Artificial Sequence
  Synthetic Construct
gcagcagggactaacgacaa

SEQ ID NO: 24335 - DNA, 18 bp, Artificial Sequence
  Synthetic Construct
tcgcactgcaacggctaa

SEQ ID NO: 24336 - DNA, 22 bp, Artificial Sequence
  Synthetic Construct
caggtggcacataggagctgaa

SEQ ID NO: 24337 - DNA, 22 bp, Artificial Sequence
  Synthetic Construct
ctgcctgttcccaatccaggaa

SEQ ID NO: 24338 - DNA, 22 bp, Artificial Sequence
  Synthetic Construct
ggggtctgaacccagctccata

SEQ ID NO: 24339 - DNA, 22 bp, Artificial Sequence
  Synthetic Construct
agcacctctacttggtcacaga

SEQ ID NO: 24340 - DNA, 22 bp, Artificial Sequence
  Synthetic Construct
ggtttccccaatacccagttca

SEQ ID NO: 24341 - DNA, 21 bp, Artificial Sequence
  Synthetic Construct
cctctgacgtgccatttgtgt

SEQ ID NO: 24342 - DNA, 19 bp, Artificial Sequence
  Synthetic Construct
ggcctgcattcccgaaact

SEQ ID NO: 24343 - DNA, 19 bp, Artificial Sequence
  Synthetic Construct
tagcaaggcctgccctcaa

SEQ ID NO: 24344 - DNA, 23 bp, Artificial Sequence
  Synthetic Construct
ggctcagaaggaactcatgcaaa

SEQ ID NO: 24345 - DNA, 24 bp, Artificial Sequence
  Synthetic Construct
gcaaggaggaacaaaagtttccat

SEQ ID NO: 24346 - DNA, 26 bp, Artificial Sequence
  Synthetic Construct
cactcctattcccaagcttccagttc

SEQ ID NO: 24347 - DNA, 21 bp, Artificial Sequence
  Synthetic Construct
accacacctgggcagaataag

SEQ ID NO: 24348 - DNA, 20 bp, Artificial Sequence
  Synthetic Construct
gccgccatgaactctactca

SEQ ID NO: 24349 - DNA, 21 bp, Artificial Sequence
  Synthetic Construct
ccccagtcaggggcttataca

SEQ ID NO: 24350 - DNA, 26 bp, Artificial Sequence
  Synthetic Construct
tgcctctcctaatctgtctttctact

SEQ ID NO: 24351 - DNA, 26 bp, Artificial Sequence
  Synthetic Construct
ctgacctaggatctgactctctctga

SEQ ID NO: 24352 - DNA, 23 bp, Artificial Sequence
  Synthetic Construct
gccaccagagacgtctttccttt

SEQ ID NO: 24353 - DNA, 24 bp, Artificial Sequence
  Synthetic Construct
gtctcaggatctgcagttgacaag

SEQ ID NO: 24354 - DNA, 21 bp, Artificial Sequence
  Synthetic Construct
accatcaccctatcccacagt

SEQ ID NO: 24355 - DNA, 25 bp, Artificial Sequence
  Synthetic Construct
cgccagtatccttcaaggtggagtt

SEQ ID NO: 24356 - DNA, 21 bp, Artificial Sequence
  Synthetic Construct
ggagctagggaagtggaggat

SEQ ID NO: 24357 - DNA, 20 bp, Artificial Sequence
  Synthetic Construct
ggaggcagctgcggtaactt

SEQ ID NO: 24358 - DNA, 20 bp, Artificial Sequence
  Synthetic Construct
ggcacagacaggaactcaca

SEQ ID NO: 24359 - DNA, 19 bp, Artificial Sequence
  Synthetic Construct
ggggctcctctgctgtgat

SEQ ID NO: 24360 - DNA, 22 bp, Artificial Sequence
  Synthetic Construct
caaacagagcaggtccgtggta

SEQ ID NO: 24361 - DNA, 23 bp, Artificial Sequence
  Synthetic Construct
aggcagcagagagtagtggttta

SEQ ID NO: 24362 - DNA, 21 bp, Artificial Sequence
  Synthetic Construct
taggcccatgccactgcagaa

SEQ ID NO: 24363 - DNA, 22 bp, Artificial Sequence
  Synthetic Construct
gtcttctgagtggtgcaaggaa

SEQ ID NO: 24364 - DNA, 21 bp, Artificial Sequence
  Synthetic Construct
gtcatagctggctgcagactt

SEQ ID NO: 24365 - DNA, 19 bp, Artificial Sequence
  Synthetic Construct
ccactccctgcccatctgt

SEQ ID NO: 24366 - DNA, 22 bp, Artificial Sequence
  Synthetic Construct
tgccttccaggagcacagagtt

SEQ ID NO: 24367 - DNA, 22 bp, Artificial Sequence
  Synthetic Construct
ggcaacccttcccttcaacctt

SEQ ID NO: 24368 - DNA, 22 bp, Artificial Sequence
  Synthetic Construct
tcaagccagtgaccggaggtta

SEQ ID NO: 24369 - DNA, 25 bp, Artificial Sequence
  Synthetic Construct
ccaaacctttcacactgtctttcaa

SEQ ID NO: 24370 - DNA, 24 bp, Artificial Sequence
  Synthetic Construct
ccttgagcagatccatccccatga

SEQ ID NO: 24371 - DNA, 22 bp, Artificial Sequence
  Synthetic Construct
ggatgctcttccaactggttca

SEQ ID NO: 24372 - DNA, 23 bp, Artificial Sequence
  Synthetic Construct
gcccagtatccctagctccatac

SEQ ID NO: 24373 - DNA, 26 bp, Artificial Sequence
  Synthetic Construct
tcctagtggaatcttctgatgcattg

SEQ ID NO: 24374 - DNA, 19 bp, Artificial Sequence
  Synthetic Construct
caggtccagggcccctttt

SEQ ID NO: 24375 - DNA, 22 bp, Artificial Sequence
  Synthetic Construct
ggcttcccattgccttccattg

SEQ ID NO: 24376 - DNA, 20 bp, Artificial Sequence
  Synthetic Construct
gcagggtctctgctcaactt

SEQ ID NO: 24377 - DNA, 23 bp, Artificial Sequence
  Synthetic Construct
ggagagtagttgcaaagctcgaa

SEQ ID NO: 24378 - DNA, 19 bp, Artificial Sequence
  Synthetic Construct
agccctgctgctgcttctt

SEQ ID NO: 24379 - DNA, 22 bp, Artificial Sequence
  Synthetic Construct
atgggcctacctgagtgacctt

SEQ ID NO: 24380 - DNA, 19 bp, Artificial Sequence
  Synthetic Construct
ctgacccggtgaccgaatg

SEQ ID NO: 24381 - DNA, 21 bp, Artificial Sequence
  Synthetic Construct
gctcaggcctgctttcttcaa

SEQ ID NO: 24382 - DNA, 20 bp, Artificial Sequence
  Synthetic Construct
tgcccggccggtacattttt

SEQ ID NO: 24383 - DNA, 20 bp, Artificial Sequence
  Synthetic Construct
aaggtaagggctcgggaact

SEQ ID NO: 24384 - DNA, 23 bp, Artificial Sequence
  Synthetic Construct
agcctccctatcattgtggatga

SEQ ID NO: 24385 - DNA, 22 bp, Artificial Sequence
  Synthetic Construct
gcagggcaaacgtcctgaagaa

SEQ ID NO: 24386 - DNA, 21 bp, Artificial Sequence
  Synthetic Construct
actcagagggactcccggtat

SEQ ID NO: 24387 - DNA, 20 bp, Artificial Sequence
  Synthetic Construct
tctcctgctgccccaccaaa

SEQ ID NO: 24388 - DNA, 21 bp, Artificial Sequence
  Synthetic Construct
tggggtgaaaacgtgaagtga

SEQ ID NO: 24389 - DNA, 21 bp, Artificial Sequence
  Synthetic Construct
agccgtggagtccatcctctt

SEQ ID NO: 24390 - DNA, 23 bp, Artificial Sequence
  Synthetic Construct
agctctcatggaagcctgtattg

SEQ ID NO: 24391 - DNA, 22 bp, Artificial Sequence
  Synthetic Construct
gcacccagacagacagaactga

SEQ ID NO: 24392 - DNA, 22 bp, Artificial Sequence
  Synthetic Construct
aagccccactaggttggtgatg

SEQ ID NO: 24393 - DNA, 21 bp, Artificial Sequence
  Synthetic Construct
gccaggagggtgcaaggattt

SEQ ID NO: 24394 - DNA, 22 bp, Artificial Sequence
  Synthetic Construct
agggagggctgctcctttagat

SEQ ID NO: 24395 - DNA, 22 bp, Artificial Sequence
  Synthetic Construct
gggcagactcaggatgggtttt

SEQ ID NO: 24396 - DNA, 20 bp, Artificial Sequence
  Synthetic Construct
agtggcaggtcaaggcatct

SEQ ID NO: 24397 - DNA, 19 bp, Artificial Sequence
  Synthetic Construct
tggcggctgctcagtcttg

SEQ ID NO: 24398 - DNA, 20 bp, Artificial Sequence
  Synthetic Construct
gggaatgaagcggggagtga

SEQ ID NO: 24399 - DNA, 23 bp, Artificial Sequence
  Synthetic Construct
cctcatcctgcagaggagcaaac

SEQ ID NO: 24400 - DNA, 26 bp, Artificial Sequence
  Synthetic Construct
gggagggatgttgaagataattggat

SEQ ID NO: 24401 - DNA, 20 bp, Artificial Sequence
  Synthetic Construct
aaccgggcccagaggttaag

SEQ ID NO: 24402 - DNA, 22 bp, Artificial Sequence
  Synthetic Construct
gcatagcttggcagtgaacttg

SEQ ID NO: 24403 - DNA, 25 bp, Artificial Sequence
  Synthetic Construct
gctgaatggatcacggaaatgatct

SEQ ID NO: 24404 - DNA, 22 bp, Artificial Sequence
  Synthetic Construct
gacagggtcagtatcccagtca

SEQ ID NO: 24405 - DNA, 20 bp, Artificial Sequence
  Synthetic Construct
agtgggaaggtgggaagcat

SEQ ID NO: 24406 - DNA, 23 bp, Artificial Sequence
  Synthetic Construct
ggatccccagacagaggattcaa

SEQ ID NO: 24407 - DNA, 23 bp, Artificial Sequence
  Synthetic Construct
cctctcaccttgagctcctgata

SEQ ID NO: 24408 - DNA, 21 bp, Artificial Sequence
  Synthetic Construct
gcctgggcaacccacattttg

SEQ ID NO: 24409 - DNA, 22 bp, Artificial Sequence
  Synthetic Construct
acacaggtggagcagaccagtt

SEQ ID NO: 24410 - DNA, 22 bp, Artificial Sequence
  Synthetic Construct
ctcatgggcacctttgacttga

SEQ ID NO: 24411 - DNA, 23 bp, Artificial Sequence
  Synthetic Construct
ccttgcaaagcgatccagacctt

SEQ ID NO: 24412 - DNA, 22 bp, Artificial Sequence
  Synthetic Construct
ggagtcaaagctccggcttcat

SEQ ID NO: 24413 - DNA, 23 bp, Artificial Sequence
  Synthetic Construct
gtgcagccaccaaactttactga

SEQ ID NO: 24414 - DNA, 22 bp, Artificial Sequence
  Synthetic Construct
ggtggcctttgttcccttgcta

SEQ ID NO: 24415 - DNA, 24 bp, Artificial Sequence
  Synthetic Construct
ctgtgaccagaatgagacatgagt

SEQ ID NO: 24416 - DNA, 25 bp, Artificial Sequence
  Synthetic Construct
caccaccttcttaggtttaccagat

SEQ ID NO: 24417 - DNA, 24 bp, Artificial Sequence
  Synthetic Construct
ggcattgcagatggagaattgact

SEQ ID NO: 24418 - DNA, 24 bp, Artificial Sequence
  Synthetic Construct
gcacccctaggttgaaccattttc

SEQ ID NO: 24419 - DNA, 22 bp, Artificial Sequence
  Synthetic Construct
ggcagaagtcaccacatcagtt

SEQ ID NO: 24420 - DNA, 20 bp, Artificial Sequence
  Synthetic Construct
tggcaattgtccaggcaaga

SEQ ID NO: 24421 - DNA, 20 bp, Artificial Sequence
  Synthetic Construct
tgtggccttcgagcatgtga

SEQ ID NO: 24422 - DNA, 24 bp, Artificial Sequence
  Synthetic Construct
acctaacatgagcagaggctctaa

SEQ ID NO: 24423 - DNA, 24 bp, Artificial Sequence
  Synthetic Construct
cgatgaaggcaccctagagctatt

SEQ ID NO: 24424 - DNA, 21 bp, Artificial Sequence
  Synthetic Construct
cagggccaagaaacacagcat

SEQ ID NO: 24425 - DNA, 20 bp, Artificial Sequence
  Synthetic Construct
agcccaacccaccagcctaa

SEQ ID NO: 24426 - DNA, 24 bp, Artificial Sequence
  Synthetic Construct
gcaggaatggaagatgaggcacaa

SEQ ID NO: 24427 - DNA, 24 bp, Artificial Sequence
  Synthetic Construct
gctaggatgaccatatccctgtga

SEQ ID NO: 24428 - DNA, 22 bp, Artificial Sequence
  Synthetic Construct
atcctctaggcccaccttcttc

SEQ ID NO: 24429 - DNA, 20 bp, Artificial Sequence
  Synthetic Construct
aaggggcatgtgcccagtaa

SEQ ID NO: 24430 - DNA, 20 bp, Artificial Sequence
  Synthetic Construct
cccctggactgtgtgcttca

SEQ ID NO: 24431 - DNA, 21 bp, Artificial Sequence
  Synthetic Construct
tcctgagacactggcctaact

SEQ ID NO: 24432 - DNA, 22 bp, Artificial Sequence
  Synthetic Construct
aagtgatggctaagtgccttgt

SEQ ID NO: 24433 - DNA, 21 bp, Artificial Sequence
  Synthetic Construct
ccacgctactgtcccgcttag

SEQ ID NO: 24434 - DNA, 21 bp, Artificial Sequence
  Synthetic Construct
tttcctgcccacccagtgaca

SEQ ID NO: 24435 - DNA, 19 bp, Artificial Sequence
  Synthetic Construct
gcgtgggcctggatgttca

SEQ ID NO: 24436 - DNA, 22 bp, Artificial Sequence
  Synthetic Construct
ggagccacagggacatgaatag

SEQ ID NO: 24437 - DNA, 22 bp, Artificial Sequence
  Synthetic Construct
tagcagcatggagtggctgagt

SEQ ID NO: 24438 - DNA, 22 bp, Artificial Sequence
  Synthetic Construct
gtgctgctaccgttactgaaca

SEQ ID NO: 24439 - DNA, 24 bp, Artificial Sequence
  Synthetic Construct
ctgtggtagaagcaggaggacact

SEQ ID NO: 24440 - DNA, 21 bp, Artificial Sequence
  Synthetic Construct
agaagcagtgttggggagcta

SEQ ID NO: 24441 - DNA, 19 bp, Artificial Sequence
  Synthetic Construct
ggcacagggctgcaacgta

SEQ ID NO: 24442 - DNA, 26 bp, Artificial Sequence
  Synthetic Construct
actcaaggtcctagtgctttacaatc

SEQ ID NO: 24443 - DNA, 21 bp, Artificial Sequence
  Synthetic Construct
gctcagcgctcagtagtctct

SEQ ID NO: 24444 - DNA, 21 bp, Artificial Sequence
  Synthetic Construct
aaggccctccagggactcaca

SEQ ID NO: 24445 - DNA, 24 bp, Artificial Sequence
  Synthetic Construct
ccagcctgtcaataaagctgagat

SEQ ID NO: 24446 - DNA, 23 bp, Artificial Sequence
  Synthetic Construct
ccccaaaacaactcagggacata

SEQ ID NO: 24447 - DNA, 23 bp, Artificial Sequence
  Synthetic Construct
ggccacgtgactcatagatgctt

SEQ ID NO: 24448 - DNA, 21 bp, Artificial Sequence
  Synthetic Construct
cacgaagctccacacactaca

SEQ ID NO: 24449 - DNA, 22 bp, Artificial Sequence
  Synthetic Construct
gcacaggagctgcagagtgaaa

SEQ ID NO: 24450 - DNA, 22 bp, Artificial Sequence
  Synthetic Construct
gggtcagagggaaaagctccat

SEQ ID NO: 24451 - DNA, 23 bp, Artificial Sequence
  Synthetic Construct
acagcgttacaatgacacacttg

SEQ ID NO: 24452 - DNA, 20 bp, Artificial Sequence
  Synthetic Construct
agagacggctgcctcgttga

SEQ ID NO: 24453 - DNA, 19 bp, Artificial Sequence
  Synthetic Construct
cccggtgaaccgcactcaa

SEQ ID NO: 24454 - DNA, 22 bp, Artificial Sequence
  Synthetic Construct
cctgtgtgcctcaatcttccaa

SEQ ID NO: 24455 - DNA, 23 bp, Artificial Sequence
  Synthetic Construct
cagaaacaggccctcaaccatga

SEQ ID NO: 24456 - DNA, 21 bp, Artificial Sequence
  Synthetic Construct
cagggcgattcttgctcatca

SEQ ID NO: 24457 - DNA, 21 bp, Artificial Sequence
  Synthetic Construct
cagggctttaggactgccatt

SEQ ID NO: 24458 - DNA, 24 bp, Artificial Sequence
  Synthetic Construct
gttccagggatttgacccttttca

SEQ ID NO: 24459 - DNA, 20 bp, Artificial Sequence
  Synthetic Construct
gccatccagcaccacagctt

SEQ ID NO: 24460 - DNA, 21 bp, Artificial Sequence
  Synthetic Construct
tcgctcctgactctgcacctt

SEQ ID NO: 24461 - DNA, 23 bp, Artificial Sequence
  Synthetic Construct
tctcacctcactgtcatctctgt

SEQ ID NO: 24462 - DNA, 21 bp, Artificial Sequence
  Synthetic Construct
tggagtggggactgagttcat

SEQ ID NO: 24463 - DNA, 20 bp, Artificial Sequence
  Synthetic Construct
gcaagtccccacctgtctgt

SEQ ID NO: 24464 - DNA, 20 bp, Artificial Sequence
  Synthetic Construct
tgagccaagcaccgtcctaa

SEQ ID NO: 24465 - DNA, 28 bp, Artificial Sequence
  Synthetic Construct
gctggaaagggtttgattcaatggatgt

SEQ ID NO: 24466 - DNA, 22 bp, Artificial Sequence
  Synthetic Construct
gattgcaggcctccatgcaaag

SEQ ID NO: 24467 - DNA, 20 bp, Artificial Sequence
  Synthetic Construct
attcctgctgccctcgcatt

SEQ ID NO: 24468 - DNA, 22 bp, Artificial Sequence
  Synthetic Construct
cagcctcaggggtgagaaatga

SEQ ID NO: 24469 - DNA, 23 bp, Artificial Sequence
  Synthetic Construct
ttgcctgaagtctctgctctaag

SEQ ID NO: 24470 - DNA, 21 bp, Artificial Sequence
  Synthetic Construct
ccagctaggacatggcagttc

SEQ ID NO: 24471 - DNA, 24 bp, Artificial Sequence
  Synthetic Construct
gcccaaatcctaccctttgtttac

SEQ ID NO: 24472 - DNA, 21 bp, Artificial Sequence
  Synthetic Construct
cccctttgccagagcacatct

SEQ ID NO: 24473 - DNA, 18 bp, Artificial Sequence
  Synthetic Construct
gcagctgggcacacagaa

SEQ ID NO: 24474 - DNA, 19 bp, Artificial Sequence
  Synthetic Construct
agagcgctccgcctgtact

SEQ ID NO: 24475 - DNA, 20 bp, Artificial Sequence
  Synthetic Construct
cacgtctgcgtgagtactgt

SEQ ID NO: 24476 - DNA, 23 bp, Artificial Sequence
  Synthetic Construct
ccagtcaaactggtctcttcagt

SEQ ID NO: 24477 - DNA, 23 bp, Artificial Sequence
  Synthetic Construct
agctcttcctcaagccaaaatct

SEQ ID NO: 24478 - DNA, 24 bp, Artificial Sequence
  Synthetic Construct
gcggtagtgtttccctctctgtag

SEQ ID NO: 24479 - DNA, 23 bp, Artificial Sequence
  Synthetic Construct
ttgcagggaaaggagagtacaag

SEQ ID NO: 24480 - DNA, 22 bp, Artificial Sequence
  Synthetic Construct
gagggagaacacctgccttgaa

SEQ ID NO: 24481 - DNA, 21 bp, Artificial Sequence
  Synthetic Construct
gtcatttcaggccacgtgcaa

SEQ ID NO: 24482 - DNA, 22 bp, Artificial Sequence
  Synthetic Construct
gcaatcccgagcttggttgaca

SEQ ID NO: 24483 - DNA, 20 bp, Artificial Sequence
  Synthetic Construct
actgcaacccgaggaagcat

SEQ ID NO: 24484 - DNA, 23 bp, Artificial Sequence
  Synthetic Construct
aatacatgcctggattgctctgt

SEQ ID NO: 24485 - DNA, 20 bp, Artificial Sequence
  Synthetic Construct
tctgctgggtgggaccattc

SEQ ID NO: 24486 - DNA, 22 bp, Artificial Sequence
  Synthetic Construct
accatggccttggagagagatg

SEQ ID NO: 24487 - DNA, 20 bp, Artificial Sequence
  Synthetic Construct
ccggatgggagcggagaatc

SEQ ID NO: 24488 - DNA, 23 bp, Artificial Sequence
  Synthetic Construct
ggatcgggatgctgaagcaatag

SEQ ID NO: 24489 - DNA, 22 bp, Artificial Sequence
  Synthetic Construct
gcatcccatcttttgccactct

SEQ ID NO: 24490 - DNA, 23 bp, Artificial Sequence
  Synthetic Construct
cacatcatggagcagctatgtct

SEQ ID NO: 24491 - DNA, 24 bp, Artificial Sequence
  Synthetic Construct
cccaatctcctttgaatggcaaac

SEQ ID NO: 24492 - DNA, 21 bp, Artificial Sequence
  Synthetic Construct
gcatcacgaggagccagtgtt

SEQ ID NO: 24493 - DNA, 20 bp, Artificial Sequence
  Synthetic Construct
ccggggccattcactggtaa

SEQ ID NO: 24494 - DNA, 23 bp, Artificial Sequence
  Synthetic Construct
cagagcctcacacaagcaatgaa

SEQ ID NO: 24495 - DNA, 22 bp, Artificial Sequence
  Synthetic Construct
ggcaaggaaggagtgcttggat

SEQ ID NO: 24496 - DNA, 20 bp, Artificial Sequence
  Synthetic Construct
tgagggagctgcaaggaaga

SEQ ID NO: 24497 - DNA, 22 bp, Artificial Sequence
  Synthetic Construct
gccatggctgacaagtctatca

SEQ ID NO: 24498 - DNA, 23 bp, Artificial Sequence
  Synthetic Construct
tgcatcgaatttgagaggcaatg

SEQ ID NO: 24499 - DNA, 21 bp, Artificial Sequence
  Synthetic Construct
aacaaccctcgtgcccctaga

SEQ ID NO: 24500 - DNA, 20 bp, Artificial Sequence
  Synthetic Construct
ccgccttggagtccctgaaa

SEQ ID NO: 24501 - DNA, 21 bp, Artificial Sequence
  Synthetic Construct
gagttccgccaggatttcact

SEQ ID NO: 24502 - DNA, 19 bp, Artificial Sequence
  Synthetic Construct
ctggggctggctgagatgt

SEQ ID NO: 24503 - DNA, 22 bp, Artificial Sequence
  Synthetic Construct
gccaggtctcgcttttggtgtt

SEQ ID NO: 24504 - DNA, 24 bp, Artificial Sequence
  Synthetic Construct
ggcaggataaaagcccctaagaag

SEQ ID NO: 24505 - DNA, 22 bp, Artificial Sequence
  Synthetic Construct
ggaggaagcccagcatcaagaa

SEQ ID NO: 24506 - DNA, 23 bp, Artificial Sequence
  Synthetic Construct
aaggagaacagatcatggtgcat

SEQ ID NO: 24507 - DNA, 21 bp, Artificial Sequence
  Synthetic Construct
gcacatccctgccttccctat

SEQ ID NO: 24508 - DNA, 22 bp, Artificial Sequence
  Synthetic Construct
aaaagcagacacagacccaact

SEQ ID NO: 24509 - DNA, 25 bp, Artificial Sequence
  Synthetic Construct
cgatgcgagttaccgagtagaaaat

SEQ ID NO: 24510 - DNA, 22 bp, Artificial Sequence
  Synthetic Construct
gccacgggaatgtttactctgt

SEQ ID NO: 24511 - DNA, 20 bp, Artificial Sequence
  Synthetic Construct
agctttgacgccaccgcttt

SEQ ID NO: 24512 - DNA, 21 bp, Artificial Sequence
  Synthetic Construct
ggtagcaccatgtgccactga

SEQ ID NO: 24513 - DNA, 22 bp, Artificial Sequence
  Synthetic Construct
cacctggcagtagccttcgatt

SEQ ID NO: 24514 - DNA, 21 bp, Artificial Sequence
  Synthetic Construct
gctgctggaaccccaagtgat

SEQ ID NO: 24515 - DNA, 23 bp, Artificial Sequence
  Synthetic Construct
ggctctagtgaagtgtggtgaac

SEQ ID NO: 24516 - DNA, 23 bp, Artificial Sequence
  Synthetic Construct
ggcctcaggaacttgagtccttt

SEQ ID NO: 24517 - DNA, 19 bp, Artificial Sequence
  Synthetic Construct
ccccaccgtgccacctttt

SEQ ID NO: 24518 - DNA, 22 bp, Artificial Sequence
  Synthetic Construct
gcttggcctgggaattgggttt

SEQ ID NO: 24519 - DNA, 22 bp, Artificial Sequence
  Synthetic Construct
cagggcaggtcagactgagaag

SEQ ID NO: 24520 - DNA, 19 bp, Artificial Sequence
  Synthetic Construct
acagcagcaccgcactgta

SEQ ID NO: 24521 - DNA, 21 bp, Artificial Sequence
  Synthetic Construct
gtcaggcgtctgcctacttct

SEQ ID NO: 24522 - DNA, 26 bp, Artificial Sequence
  Synthetic Construct
cactttccaagtgcctggtaatggtt

SEQ ID NO: 24523 - DNA, 21 bp, Artificial Sequence
  Synthetic Construct
aggtgggagctgacacgtatt

SEQ ID NO: 24524 - DNA, 24 bp, Artificial Sequence
  Synthetic Construct
gccctgaatcccaaggaaacaatc

SEQ ID NO: 24525 - DNA, 24 bp, Artificial Sequence
  Synthetic Construct
ggcttctcatccaactcagtacaa

SEQ ID NO: 24526 - DNA, 22 bp, Artificial Sequence
  Synthetic Construct
cccaagcctacgtgacaccaaa

SEQ ID NO: 24527 - DNA, 22 bp, Artificial Sequence
  Synthetic Construct
gcccagtactgagaccaagaaa

SEQ ID NO: 24528 - DNA, 22 bp, Artificial Sequence
  Synthetic Construct
gcgcttatccaagctaggttct

SEQ ID NO: 24529 - DNA, 24 bp, Artificial Sequence
  Synthetic Construct
cacatggtttccctcctccttttt

SEQ ID NO: 24530 - DNA, 20 bp, Artificial Sequence
  Synthetic Construct
tcgtggcaccatctcacaaa

SEQ ID NO: 24531 - DNA, 19 bp, Artificial Sequence
  Synthetic Construct
gccagggagcagcacaaag

SEQ ID NO: 24532 - DNA, 22 bp, Artificial Sequence
  Synthetic Construct
caccctcctgtcaccttcattc

SEQ ID NO: 24533 - DNA, 21 bp, Artificial Sequence
  Synthetic Construct
cccctgctcccatgacacaat

SEQ ID NO: 24534 - DNA, 21 bp, Artificial Sequence
  Synthetic Construct
gcagtgagtggcagctattgt

SEQ ID NO: 24535 - DNA, 24 bp, Artificial Sequence
  Synthetic Construct
gttcttacctctagacctgtgcaa

SEQ ID NO: 24536 - DNA, 22 bp, Artificial Sequence
  Synthetic Construct
ttgggcatggagggaggtaaca

SEQ ID NO: 24537 - DNA, 22 bp, Artificial Sequence
  Synthetic Construct
ctgggaagtgcaaggggtcaaa

SEQ ID NO: 24538 - DNA, 22 bp, Artificial Sequence
  Synthetic Construct
tgctaagaaggctatgctgcaa

SEQ ID NO: 24539 - DNA, 20 bp, Artificial Sequence
  Synthetic Construct
acctgaaggagggagtgtgt

SEQ ID NO: 24540 - DNA, 23 bp, Artificial Sequence
  Synthetic Construct
gcccagattcctgagggctttag

SEQ ID NO: 24541 - DNA, 25 bp, Artificial Sequence
  Synthetic Construct
ggctctttggtggttagctggacta

SEQ ID NO: 24542 - DNA, 20 bp, Artificial Sequence
  Synthetic Construct
ggcccctctgcaaataccaa

SEQ ID NO: 24543 - DNA, 23 bp, Artificial Sequence
  Synthetic Construct
caccagatgctcctaggtgtaga

SEQ ID NO: 24544 - DNA, 23 bp, Artificial Sequence
  Synthetic Construct
gaaccgtctccttctccaagttc

SEQ ID NO: 24545 - DNA, 22 bp, Artificial Sequence
  Synthetic Construct
gccctgtgaagccagtctctat

SEQ ID NO: 24546 - DNA, 22 bp, Artificial Sequence
  Synthetic Construct
acacctgagagaccctcgcttt

SEQ ID NO: 24547 - DNA, 22 bp, Artificial Sequence
  Synthetic Construct
ccgtcaccccagtctcacctat

SEQ ID NO: 24548 - DNA, 22 bp, Artificial Sequence
  Synthetic Construct
gggaagctgtagttgcagtgat

SEQ ID NO: 24549 - DNA, 22 bp, Artificial Sequence
  Synthetic Construct
gccctctgctgacagtgtgaaa

SEQ ID NO: 24550 - DNA, 26 bp, Artificial Sequence
  Synthetic Construct
gaagtaaagtggaccttgacatctga

SEQ ID NO: 24551 - DNA, 22 bp, Artificial Sequence
  Synthetic Construct
cctggtggctcaaaccgttagt

SEQ ID NO: 24552 - DNA, 23 bp, Artificial Sequence
  Synthetic Construct
cacagagtgtgactcaggtcaag

SEQ ID NO: 24553 - DNA, 20 bp, Artificial Sequence
  Synthetic Construct
ggccgtggggagtagggtta

SEQ ID NO: 24554 - DNA, 22 bp, Artificial Sequence
  Synthetic Construct
caaggtccagaagccaaagcta

SEQ ID NO: 24555 - DNA, 25 bp, Artificial Sequence
  Synthetic Construct
ccctggctgatttatgagaaaggta

SEQ ID NO: 24556 - DNA, 21 bp, Artificial Sequence
  Synthetic Construct
tgatgggtggcttccctaact

SEQ ID NO: 24557 - DNA, 24 bp, Artificial Sequence
  Synthetic Construct
tctcggttaactgcaaaaggacaa

SEQ ID NO: 24558 - DNA, 20 bp, Artificial Sequence
  Synthetic Construct
tctggccttccggtcttttg

SEQ ID NO: 24559 - DNA, 24 bp, Artificial Sequence
  Synthetic Construct
gccagaagtcacaaaccaaagaca

SEQ ID NO: 24560 - DNA, 22 bp, Artificial Sequence
  Synthetic Construct
gcaagagtggtagcctcaagat

SEQ ID NO: 24561 - DNA, 25 bp, Artificial Sequence
  Synthetic Construct
cacaggagggtgatgttatctgtct

SEQ ID NO: 24562 - DNA, 24 bp, Artificial Sequence
  Synthetic Construct
gctgacattggtggtctgtagctt

SEQ ID NO: 24563 - DNA, 23 bp, Artificial Sequence
  Synthetic Construct
ctggcatgtgaattgctgtggat

SEQ ID NO: 24564 - DNA, 23 bp, Artificial Sequence
  Synthetic Construct
gtaggccaaggttgccttaaaac

SEQ ID NO: 24565 - DNA, 21 bp, Artificial Sequence
  Synthetic Construct
ccatcagcagcctgaatgctt

SEQ ID NO: 24566 - DNA, 24 bp, Artificial Sequence
  Synthetic Construct
tgatgagcacgtgaaagtttgaga

SEQ ID NO: 24567 - DNA, 22 bp, Artificial Sequence
  Synthetic Construct
gcgtgaagccaggacttcctaa

SEQ ID NO: 24568 - DNA, 24 bp, Artificial Sequence
  Synthetic Construct
cgcaaagcccctttaactgctgat

SEQ ID NO: 24569 - DNA, 21 bp, Artificial Sequence
  Synthetic Construct
cctccctcaccagtgggtctt

SEQ ID NO: 24570 - DNA, 22 bp, Artificial Sequence
  Synthetic Construct
ccctgcaagactggttgtgtga

SEQ ID NO: 24571 - DNA, 25 bp, Artificial Sequence
  Synthetic Construct
gccttagccacagaatccattcaca

SEQ ID NO: 24572 - DNA, 22 bp, Artificial Sequence
  Synthetic Construct
accactgggatgaactccaaca

SEQ ID NO: 24573 - DNA, 22 bp, Artificial Sequence
  Synthetic Construct
tcaggcaagctggaaatgagtt

SEQ ID NO: 24574 - DNA, 25 bp, Artificial Sequence
  Synthetic Construct
ctcagtgggatctggttacttgttc

SEQ ID NO: 24575 - DNA, 23 bp, Artificial Sequence
  Synthetic Construct
gccctaatgatgggcacaaggtt

SEQ ID NO: 24576 - DNA, 21 bp, Artificial Sequence
  Synthetic Construct
tgccttctgagaccggcaaga

SEQ ID NO: 24577 - DNA, 22 bp, Artificial Sequence
  Synthetic Construct
ccagtgctcactgtccagttca

SEQ ID NO: 24578 - DNA, 22 bp, Artificial Sequence
  Synthetic Construct
gcacatggcctggaagagatga

SEQ ID NO: 24579 - DNA, 22 bp, Artificial Sequence
  Synthetic Construct
cctcctgatttcgcctctcttc

SEQ ID NO: 24580 - DNA, 22 bp, Artificial Sequence
  Synthetic Construct
taatgcagcccactggccttac

SEQ ID NO: 24581 - DNA, 22 bp, Artificial Sequence
  Synthetic Construct
aggagtgaccaatgccatgaat

SEQ ID NO: 24582 - DNA, 19 bp, Artificial Sequence
  Synthetic Construct
gcagacggccctgagacaa

SEQ ID NO: 24583 - DNA, 20 bp, Artificial Sequence
  Synthetic Construct
gcttccaggctccattgtgt

SEQ ID NO: 24584 - DNA, 24 bp, Artificial Sequence
  Synthetic Construct
catcaaccatgtgagggacactct

SEQ ID NO: 24585 - DNA, 22 bp, Artificial Sequence
  Synthetic Construct
acccagcttccagagactgctt

SEQ ID NO: 24586 - DNA, 21 bp, Artificial Sequence
  Synthetic Construct
gcaatgaaggccatggagaca

SEQ ID NO: 24587 - DNA, 21 bp, Artificial Sequence
  Synthetic Construct
accccggagacaatgttcatc

SEQ ID NO: 24588 - DNA, 22 bp, Artificial Sequence
  Synthetic Construct
ttggtaggcttgggtctagtca

SEQ ID NO: 24589 - DNA, 20 bp, Artificial Sequence
  Synthetic Construct
aggcaccaggcaagagtttg

SEQ ID NO: 24590 - DNA, 22 bp, Artificial Sequence
  Synthetic Construct
ccctctgcttcctcctggtgat

SEQ ID NO: 24591 - DNA, 24 bp, Artificial Sequence
  Synthetic Construct
tgaatgcctttgcttatggctcta

SEQ ID NO: 24592 - DNA, 19 bp, Artificial Sequence
  Synthetic Construct
gccagacgagctgcacact

SEQ ID NO: 24593 - DNA, 20 bp, Artificial Sequence
  Synthetic Construct
tgcgggacaccagactgatt

SEQ ID NO: 24594 - DNA, 25 bp, Artificial Sequence
  Synthetic Construct
ggaatcccgtcacttacaagtacaa

SEQ ID NO: 24595 - DNA, 21 bp, Artificial Sequence
  Synthetic Construct
acaaggggagtggcattttgt

SEQ ID NO: 24596 - DNA, 22 bp, Artificial Sequence
  Synthetic Construct
aaccatgcccctagtccacagt

SEQ ID NO: 24597 - DNA, 23 bp, Artificial Sequence
  Synthetic Construct
acaggtgatcagctctggatctt

SEQ ID NO: 24598 - DNA, 22 bp, Artificial Sequence
  Synthetic Construct
agtggggagggtgttacagaga

SEQ ID NO: 24599 - DNA, 18 bp, Artificial Sequence
  Synthetic Construct
accccagctcccagcaaa

SEQ ID NO: 24600 - DNA, 22 bp, Artificial Sequence
  Synthetic Construct
cgcatggtcatagcatcgcatt

SEQ ID NO: 24601 - DNA, 20 bp, Artificial Sequence
  Synthetic Construct
agggtgggtgctggagtaca

SEQ ID NO: 24602 - DNA, 27 bp, Artificial Sequence
  Synthetic Construct
gggaaaagtcggtacatcaagatgaga

SEQ ID NO: 24603 - DNA, 18 bp, Artificial Sequence
  Synthetic Construct
agagcagccccaggttct

SEQ ID NO: 24604 - DNA, 25 bp, Artificial Sequence
  Synthetic Construct
gcactgaagatgacaagtaccacaa

SEQ ID NO: 24605 - DNA, 21 bp, Artificial Sequence
  Synthetic Construct
gcatggggccttttcccacaa

SEQ ID NO: 24606 - DNA, 22 bp, Artificial Sequence
  Synthetic Construct
caggctcaggccctccttttat

SEQ ID NO: 24607 - DNA, 19 bp, Artificial Sequence
  Synthetic Construct
tcccctgcagaaccacaga

SEQ ID NO: 24608 - DNA, 23 bp, Artificial Sequence
  Synthetic Construct
ctgggttcaaatcactgggagat

SEQ ID NO: 24609 - DNA, 20 bp, Artificial Sequence
  Synthetic Construct
tccgcgcagaggaaagttgt

SEQ ID NO: 24610 - DNA, 26 bp, Artificial Sequence
  Synthetic Construct
gccaatactatagcaccagcttttga

SEQ ID NO: 24611 - DNA, 22 bp, Artificial Sequence
  Synthetic Construct
gccactcaggggtggatctttt

SEQ ID NO: 24612 - DNA, 25 bp, Artificial Sequence
  Synthetic Construct
aatgtcttcaggagatgagatgcaa

SEQ ID NO: 24613 - DNA, 22 bp, Artificial Sequence
  Synthetic Construct
gtgtgtggctggatgctcagaa

SEQ ID NO: 24614 - DNA, 22 bp, Artificial Sequence
  Synthetic Construct
cgtagaagggctgcgggaaaat

SEQ ID NO: 24615 - DNA, 22 bp, Artificial Sequence
  Synthetic Construct
aggcgctaaaaagctgacaaag

SEQ ID NO: 24616 - DNA, 21 bp, Artificial Sequence
  Synthetic Construct
gcacctgtgttcacgcatttc

SEQ ID NO: 24617 - DNA, 23 bp, Artificial Sequence
  Synthetic Construct
gggctcattcactaggagtgttg

SEQ ID NO: 24618 - DNA, 22 bp, Artificial Sequence
  Synthetic Construct
gttagggcttaggggtctgaac

SEQ ID NO: 24619 - DNA, 20 bp, Artificial Sequence
  Synthetic Construct
agcagccaggaaggctgatg

SEQ ID NO: 24620 - DNA, 22 bp, Artificial Sequence
  Synthetic Construct
gcttagctgcaccggacatctt

SEQ ID NO: 24621 - DNA, 25 bp, Artificial Sequence
  Synthetic Construct
cataggcacttgatcatcctgtact

SEQ ID NO: 24622 - DNA, 23 bp, Artificial Sequence
  Synthetic Construct
ggagttgtccgtggtactgattg

SEQ ID NO: 24623 - DNA, 21 bp, Artificial Sequence
  Synthetic Construct
acacgtccctcctggagtttc

SEQ ID NO: 24624 - DNA, 22 bp, Artificial Sequence
  Synthetic Construct
ccacacgttttggcaacgtaga

SEQ ID NO: 24625 - DNA, 24 bp, Artificial Sequence
  Synthetic Construct
gcttccccactgctacttcctatg

SEQ ID NO: 24626 - DNA, 22 bp, Artificial Sequence
  Synthetic Construct
gaggcggtacataagtcagcaa

SEQ ID NO: 24627 - DNA, 18 bp, Artificial Sequence
  Synthetic Construct
tgcaggctgtcgcgtact

SEQ ID NO: 24628 - DNA, 21 bp, Artificial Sequence
  Synthetic Construct
ccaactgccactgaccaaaag

SEQ ID NO: 24629 - DNA, 23 bp, Artificial Sequence
  Synthetic Construct
gctcacttgccagaacagttaag

SEQ ID NO: 24630 - DNA, 20 bp, Artificial Sequence
  Synthetic Construct
agcagctggactgcttgact

SEQ ID NO: 24631 - DNA, 23 bp, Artificial Sequence
  Synthetic Construct
caaaggagccacaatggtaggta

SEQ ID NO: 24632 - DNA, 25 bp, Artificial Sequence
  Synthetic Construct
gcatttgtgtaccctgtttcctttc

SEQ ID NO: 24633 - DNA, 25 bp, Artificial Sequence
  Synthetic Construct
tgtgtgattttcagggctaagaagt

SEQ ID NO: 24634 - DNA, 22 bp, Artificial Sequence
  Synthetic Construct
tctaggccccatgactgaagtt

SEQ ID NO: 24635 - DNA, 22 bp, Artificial Sequence
  Synthetic Construct
gttgcttgcccaaagtcagaag

SEQ ID NO: 24636 - DNA, 24 bp, Artificial Sequence
  Synthetic Construct
gcccaagtttagtcagcaggtcaa

SEQ ID NO: 24637 - DNA, 22 bp, Artificial Sequence
  Synthetic Construct
ggcctcagctttggaaatggat

SEQ ID NO: 24638 - DNA, 22 bp, Artificial Sequence
  Synthetic Construct
ggactggctctcctctccagtt

SEQ ID NO: 24639 - DNA, 21 bp, Artificial Sequence
  Synthetic Construct
agccaaaagttgtgccactga

SEQ ID NO: 24640 - DNA, 24 bp, Artificial Sequence
  Synthetic Construct
caggcatatagaactcctgccatt

SEQ ID NO: 24641 - DNA, 22 bp, Artificial Sequence
  Synthetic Construct
tgggtggaagagagccttgagt

SEQ ID NO: 24642 - DNA, 22 bp, Artificial Sequence
  Synthetic Construct
aaggactgcccctcctcagaaa

SEQ ID NO: 24643 - DNA, 19 bp, Artificial Sequence
  Synthetic Construct
tggcatgccggcacattga

SEQ ID NO: 24644 - DNA, 19 bp, Artificial Sequence
  Synthetic Construct
gcaccaccatggcgacaca

SEQ ID NO: 24645 - DNA, 25 bp, Artificial Sequence
  Synthetic Construct
ggagaaaaacccttctcacgcatca

SEQ ID NO: 24646 - DNA, 24 bp, Artificial Sequence
  Synthetic Construct
ggggatcaatgcaaactctgtagt

SEQ ID NO: 24647 - DNA, 21 bp, Artificial Sequence
  Synthetic Construct
tgcctaccttgggagggttca

SEQ ID NO: 24648 - DNA, 21 bp, Artificial Sequence
  Synthetic Construct
caccacacctctcccttctga

SEQ ID NO: 24649 - DNA, 22 bp, Artificial Sequence
  Synthetic Construct
ccactttcgatgaccgccttgt

SEQ ID NO: 24650 - DNA, 22 bp, Artificial Sequence
  Synthetic Construct
tgtggcacctcacagctatttt

SEQ ID NO: 24651 - DNA, 23 bp, Artificial Sequence
  Synthetic Construct
gcccgagcaagtcatatccaaac

SEQ ID NO: 24652 - DNA, 18 bp, Artificial Sequence
  Synthetic Construct
tgcccctggccttcatgt

SEQ ID NO: 24653 - DNA, 22 bp, Artificial Sequence
  Synthetic Construct
ctgcctcactccagatctcaca

SEQ ID NO: 24654 - DNA, 23 bp, Artificial Sequence
  Synthetic Construct
gaggaaggacacctcttctgttg

SEQ ID NO: 24655 - DNA, 20 bp, Artificial Sequence
  Synthetic Construct
ccggggttcagaaggagcat

SEQ ID NO: 24656 - DNA, 20 bp, Artificial Sequence
  Synthetic Construct
agccaccgtgggaggaagaa

SEQ ID NO: 24657 - DNA, 25 bp, Artificial Sequence
  Synthetic Construct
aaaatcagctgactgtatggagact

SEQ ID NO: 24658 - DNA, 25 bp, Artificial Sequence
  Synthetic Construct
gttgccatttattcctggtgaatgt

SEQ ID NO: 24659 - DNA, 22 bp, Artificial Sequence
  Synthetic Construct
gcaggcaagggcttcagaaaga

SEQ ID NO: 24660 - DNA, 19 bp, Artificial Sequence
  Synthetic Construct
tgcagcctgggtgggtttt

SEQ ID NO: 24661 - DNA, 20 bp, Artificial Sequence
  Synthetic Construct
aggccccagctgcactaact

SEQ ID NO: 24662 - DNA, 19 bp, Artificial Sequence
  Synthetic Construct
aggagcccctggactgttc

SEQ ID NO: 24663 - DNA, 23 bp, Artificial Sequence
  Synthetic Construct
gttacttgttcctgctgccttga

SEQ ID NO: 24664 - DNA, 24 bp, Artificial Sequence
  Synthetic Construct
ctccctgtatccaaacgaggcatt

SEQ ID NO: 24665 - DNA, 24 bp, Artificial Sequence
  Synthetic Construct
ggggcactgtacacctaccttaga

SEQ ID NO: 24666 - DNA, 23 bp, Artificial Sequence
  Synthetic Construct
gtctactgtgtcacgctgtgctt

SEQ ID NO: 24667 - DNA, 24 bp, Artificial Sequence
  Synthetic Construct
gggttgctgaggacagatgcaaac

SEQ ID NO: 24668 - DNA, 21 bp, Artificial Sequence
  Synthetic Construct
gctcctggcctgagttagcaa

SEQ ID NO: 24669 - DNA, 25 bp, Artificial Sequence
  Synthetic Construct
ccatggatactcggtccatttcaag

SEQ ID NO: 24670 - DNA, 22 bp, Artificial Sequence
  Synthetic Construct
ggagcgtgagaatgaaccatga

SEQ ID NO: 24671 - DNA, 22 bp, Artificial Sequence
  Synthetic Construct
ggtgtgacttttccaggctagt

SEQ ID NO: 24672 - DNA, 22 bp, Artificial Sequence
  Synthetic Construct
ggcctttcgtgtctggaatttg

SEQ ID NO: 24673 - DNA, 23 bp, Artificial Sequence
  Synthetic Construct
gaatatctgagccacctgctctt

SEQ ID NO: 24674 - DNA, 20 bp, Artificial Sequence
  Synthetic Construct
ggactgcgacagttgtgaga

SEQ ID NO: 24675 - DNA, 22 bp, Artificial Sequence
  Synthetic Construct
gagatctccctgtgcctgagat

SEQ ID NO: 24676 - DNA, 20 bp, Artificial Sequence
  Synthetic Construct
tgccacctcctcaaccttgt

SEQ ID NO: 24677 - DNA, 22 bp, Artificial Sequence
  Synthetic Construct
caccacctttcttgtccagctt

SEQ ID NO: 24678 - DNA, 25 bp, Artificial Sequence
  Synthetic Construct
agtaagtaaagcaggaacagagcat

SEQ ID NO: 24679 - DNA, 20 bp, Artificial Sequence
  Synthetic Construct
aggccgctgagaggattgtt

SEQ ID NO: 24680 - DNA, 21 bp, Artificial Sequence
  Synthetic Construct
ccagccttgccctgttgtttg

SEQ ID NO: 24681 - DNA, 24 bp, Artificial Sequence
  Synthetic Construct
ctccggaaaatctgagccatgttc

SEQ ID NO: 24682 - DNA, 23 bp, Artificial Sequence
  Synthetic Construct
gggattgctaatgccacgtcaga

SEQ ID NO: 24683 - DNA, 22 bp, Artificial Sequence
  Synthetic Construct
cagaaggaatcgggccatgtgt

SEQ ID NO: 24684 - DNA, 22 bp, Artificial Sequence
  Synthetic Construct
cagataaggcaggtgaggcatt

SEQ ID NO: 24685 - DNA, 23 bp, Artificial Sequence
  Synthetic Construct
accagatgtctggcattcattgt

SEQ ID NO: 24686 - DNA, 20 bp, Artificial Sequence
  Synthetic Construct
ggctcattccagccctttct

SEQ ID NO: 24687 - DNA, 21 bp, Artificial Sequence
  Synthetic Construct
taggagagccgaggtcagact

SEQ ID NO: 24688 - DNA, 26 bp, Artificial Sequence
  Synthetic Construct
ccaggggaagatatttaactccagaa

SEQ ID NO: 24689 - DNA, 22 bp, Artificial Sequence
  Synthetic Construct
ccactttctagcccagggattc

SEQ ID NO: 24690 - DNA, 24 bp, Artificial Sequence
  Synthetic Construct
ccagcgagagaagttcagttgtga

SEQ ID NO: 24691 - DNA, 21 bp, Artificial Sequence
  Synthetic Construct
ctgggatgccaaggggttatt

SEQ ID NO: 24692 - DNA, 21 bp, Artificial Sequence
  Synthetic Construct
gaaacagcacaacccctgact

SEQ ID NO: 24693 - DNA, 19 bp, Artificial Sequence
  Synthetic Construct
gggcagagggacggaagat

SEQ ID NO: 24694 - DNA, 21 bp, Artificial Sequence
  Synthetic Construct
caggatccggggcactacttc

SEQ ID NO: 24695 - DNA, 23 bp, Artificial Sequence
  Synthetic Construct
gtcaaaggaagctgccctaggta

SEQ ID NO: 24696 - DNA, 22 bp, Artificial Sequence
  Synthetic Construct
gactggagagtgtgggcttctt

SEQ ID NO: 24697 - DNA, 22 bp, Artificial Sequence
  Synthetic Construct
ccactgaagcaaaggctgtcaa

SEQ ID NO: 24698 - DNA, 21 bp, Artificial Sequence
  Synthetic Construct
tgttggcaccaccattggttt

SEQ ID NO: 24699 - DNA, 21 bp, Artificial Sequence
  Synthetic Construct
tgtcttccccagacctccttt

SEQ ID NO: 24700 - DNA, 21 bp, Artificial Sequence
  Synthetic Construct
tgagtgcttcagttgccagtt

SEQ ID NO: 24701 - DNA, 23 bp, Artificial Sequence
  Synthetic Construct
gatgccacagagagtcaccacta

SEQ ID NO: 24702 - DNA, 23 bp, Artificial Sequence
  Synthetic Construct
gctaggagatttctctggcaaca

SEQ ID NO: 24703 - DNA, 21 bp, Artificial Sequence
  Synthetic Construct
gcccaaggacgttggtcagaa

SEQ ID NO: 24704 - DNA, 19 bp, Artificial Sequence
  Synthetic Construct
tgcagggctgccagtgctt

SEQ ID NO: 24705 - DNA, 22 bp, Artificial Sequence
  Synthetic Construct
cctccctacccaagtggctaca

SEQ ID NO: 24706 - DNA, 20 bp, Artificial Sequence
  Synthetic Construct
aggaagcgccccatatgctt

SEQ ID NO: 24707 - DNA, 22 bp, Artificial Sequence
  Synthetic Construct
ggtatggttgtgagtgctggtt

SEQ ID NO: 24708 - DNA, 26 bp, Artificial Sequence
  Synthetic Construct
gtgctgtgatcagactgctttacatt

SEQ ID NO: 24709 - DNA, 20 bp, Artificial Sequence
  Synthetic Construct
cttggctgagcctcctttga

SEQ ID NO: 24710 - DNA, 20 bp, Artificial Sequence
  Synthetic Construct
caccggatcctgctgtcttt

SEQ ID NO: 24711 - DNA, 23 bp, Artificial Sequence
  Synthetic Construct
gtgaggccctctctcaaaaagaa

SEQ ID NO: 24712 - DNA, 20 bp, Artificial Sequence
  Synthetic Construct
tgggcaaagcagtgtgatga

SEQ ID NO: 24713 - DNA, 21 bp, Artificial Sequence
  Synthetic Construct
ctgcacgtccatcacatcctt

SEQ ID NO: 24714 - DNA, 25 bp, Artificial Sequence
  Synthetic Construct
tgataaattcctggaggcctagaac

SEQ ID NO: 24715 - DNA, 24 bp, Artificial Sequence
  Synthetic Construct
cctcagtgcaactgaaaccctgaa

SEQ ID NO: 24716 - DNA, 24 bp, Artificial Sequence
  Synthetic Construct
gagatgtgggtaggtggagagaag

SEQ ID NO: 24717 - DNA, 20 bp, Artificial Sequence
  Synthetic Construct
gggtgcagacacatgggtaa

SEQ ID NO: 24718 - DNA, 24 bp, Artificial Sequence
  Synthetic Construct
aggggatcaagatgtggcttttag

SEQ ID NO: 24719 - DNA, 22 bp, Artificial Sequence
  Synthetic Construct
ctgaatgccacgacacctcact

SEQ ID NO: 24720 - DNA, 26 bp, Artificial Sequence
  Synthetic Construct
cagagcagagatgcttcagaaacaaa

SEQ ID NO: 24721 - DNA, 21 bp, Artificial Sequence
  Synthetic Construct
ggacacgtctctccgtttgaa

SEQ ID NO: 24722 - DNA, 23 bp, Artificial Sequence
  Synthetic Construct
ggacaacttaacgctgccactct

SEQ ID NO: 24723 - DNA, 24 bp, Artificial Sequence
  Synthetic Construct
cacggagtctctaccactgtcatc

SEQ ID NO: 24724 - DNA, 19 bp, Artificial Sequence
  Synthetic Construct
gtgccagggtgtccagcaa

SEQ ID NO: 24725 - DNA, 22 bp, Artificial Sequence
  Synthetic Construct
ctgggattcctcacctcacctt

SEQ ID NO: 24726 - DNA, 24 bp, Artificial Sequence
  Synthetic Construct
acttctgaccaacaagcagtctac

SEQ ID NO: 24727 - DNA, 23 bp, Artificial Sequence
  Synthetic Construct
ctcacagcacagaagtgggatga

SEQ ID NO: 24728 - DNA, 20 bp, Artificial Sequence
  Synthetic Construct
acggggaagtgggtgaagaa

SEQ ID NO: 24729 - DNA, 20 bp, Artificial Sequence
  Synthetic Construct
tgctgccttctcggcattga

SEQ ID NO: 24730 - DNA, 19 bp, Artificial Sequence
  Synthetic Construct
agctgcaccggacgtttgt

SEQ ID NO: 24731 - DNA, 20 bp, Artificial Sequence
  Synthetic Construct
ggagcaaagccctcgtgcat

SEQ ID NO: 24732 - DNA, 22 bp, Artificial Sequence
  Synthetic Construct
cagggctcactgcttcagacaa

SEQ ID NO: 24733 - DNA, 20 bp, Artificial Sequence
  Synthetic Construct
ctggaggggctgacaaccta

SEQ ID NO: 24734 - DNA, 20 bp, Artificial Sequence
  Synthetic Construct
agcagccgctccatgttact

SEQ ID NO: 24735 - DNA, 22 bp, Artificial Sequence
  Synthetic Construct
ccaggacagaggcagatgcaat

SEQ ID NO: 24736 - DNA, 23 bp, Artificial Sequence
  Synthetic Construct
ctgcagctcaagtcttcctcact

SEQ ID NO: 24737 - DNA, 26 bp, Artificial Sequence
  Synthetic Construct
gcaacccatatgcaatgagaccaagt

SEQ ID NO: 24738 - DNA, 21 bp, Artificial Sequence
  Synthetic Construct
acagtgccttgaggaggaagt

SEQ ID NO: 24739 - DNA, 20 bp, Artificial Sequence
  Synthetic Construct
gccagcacttcaagcacgtt

SEQ ID NO: 24740 - DNA, 21 bp, Artificial Sequence
  Synthetic Construct
gtcctccagggcatcatctgt

SEQ ID NO: 24741 - DNA, 22 bp, Artificial Sequence
  Synthetic Construct
cccgcctttcccatctcctact

SEQ ID NO: 24742 - DNA, 19 bp, Artificial Sequence
  Synthetic Construct
tcgtggaggtccggggaaa

SEQ ID NO: 24743 - DNA, 22 bp, Artificial Sequence
  Synthetic Construct
tgcaccactcagtcggaatcta

SEQ ID NO: 24744 - DNA, 22 bp, Artificial Sequence
  Synthetic Construct
agaggtgctcctcctccatctt

SEQ ID NO: 24745 - DNA, 22 bp, Artificial Sequence
  Synthetic Construct
gggccctcctgatgaccttctt

SEQ ID NO: 24746 - DNA, 23 bp, Artificial Sequence
  Synthetic Construct
ctggggtctagacaagtgaccat

SEQ ID NO: 24747 - DNA, 22 bp, Artificial Sequence
  Synthetic Construct
caagaggcgtagaagtgcagta

SEQ ID NO: 24748 - DNA, 21 bp, Artificial Sequence
  Synthetic Construct
tgtcccctgcccaaacactga

SEQ ID NO: 24749 - DNA, 24 bp, Artificial Sequence
  Synthetic Construct
ctggtaagtcaccctcttggtctt

SEQ ID NO: 24750 - DNA, 22 bp, Artificial Sequence
  Synthetic Construct
ctgactgtggccaatccacttg

SEQ ID NO: 24751 - DNA, 23 bp, Artificial Sequence
  Synthetic Construct
aaagcagaagtacaggctcatca

SEQ ID NO: 24752 - DNA, 24 bp, Artificial Sequence
  Synthetic Construct
cgaaacttccaatggacaccagaa

SEQ ID NO: 24753 - DNA, 22 bp, Artificial Sequence
  Synthetic Construct
aagatggccagagcccctgtag

SEQ ID NO: 24754 - DNA, 22 bp, Artificial Sequence
  Synthetic Construct
ccagaggagctcagggatgtat

SEQ ID NO: 24755 - DNA, 23 bp, Artificial Sequence
  Synthetic Construct
ctgaggcccataagcctatcagt

SEQ ID NO: 24756 - DNA, 23 bp, Artificial Sequence
  Synthetic Construct
atgtcagccgattctccttttct

SEQ ID NO: 24757 - DNA, 20 bp, Artificial Sequence
  Synthetic Construct
cctgccactccccaagagat

SEQ ID NO: 24758 - DNA, 24 bp, Artificial Sequence
  Synthetic Construct
gagtggagttcggtccttctctga

SEQ ID NO: 24759 - DNA, 21 bp, Artificial Sequence
  Synthetic Construct
cccagtccgggaggttgttac

SEQ ID NO: 24760 - DNA, 24 bp, Artificial Sequence
  Synthetic Construct
gcggagggagactcagaattgcat

SEQ ID NO: 24761 - DNA, 22 bp, Artificial Sequence
  Synthetic Construct
gcagctacctccctgcagtttt

SEQ ID NO: 24762 - DNA, 22 bp, Artificial Sequence
  Synthetic Construct
gccaatgcccacctaacacact

SEQ ID NO: 24763 - DNA, 22 bp, Artificial Sequence
  Synthetic Construct
tgacagacaggcatgaatcaca

SEQ ID NO: 24764 - DNA, 20 bp, Artificial Sequence
  Synthetic Construct
ggccgttttgcccaaagtag

SEQ ID NO: 24765 - DNA, 20 bp, Artificial Sequence
  Synthetic Construct
ttccggagccacttgcatca

SEQ ID NO: 24766 - DNA, 23 bp, Artificial Sequence
  Synthetic Construct
cactgttccagagcacattcact

SEQ ID NO: 24767 - DNA, 21 bp, Artificial Sequence
  Synthetic Construct
gcttgcagctgaggagtgagt

SEQ ID NO: 24768 - DNA, 22 bp, Artificial Sequence
  Synthetic Construct
cccctgagttcatgggcttgat

SEQ ID NO: 24769 - DNA, 19 bp, Artificial Sequence
  Synthetic Construct
tgcagagaggcccgtgatg

SEQ ID NO: 24770 - DNA, 26 bp, Artificial Sequence
  Synthetic Construct
gcagttaagagggtactctgctgttg

SEQ ID NO: 24771 - DNA, 22 bp, Artificial Sequence
  Synthetic Construct
ggccacacacgaacatttacaa

SEQ ID NO: 24772 - DNA, 26 bp, Artificial Sequence
  Synthetic Construct
gggaaacacacatgtactttgagcat

SEQ ID NO: 24773 - DNA, 21 bp, Artificial Sequence
  Synthetic Construct
gctcatggctctctgcacttc

SEQ ID NO: 24774 - DNA, 23 bp, Artificial Sequence
  Synthetic Construct
ccttatccttgaactgccggtaa

SEQ ID NO: 24775 - DNA, 20 bp, Artificial Sequence
  Synthetic Construct
accgctgcacttctgtgact

SEQ ID NO: 24776 - DNA, 24 bp, Artificial Sequence
  Synthetic Construct
acaacagacgagttcatgtgaaga

SEQ ID NO: 24777 - DNA, 22 bp, Artificial Sequence
  Synthetic Construct
gtcagaaacaactggggcatca

SEQ ID NO: 24778 - DNA, 22 bp, Artificial Sequence
  Synthetic Construct
ggttggctcttgaggacattga

SEQ ID NO: 24779 - DNA, 20 bp, Artificial Sequence
  Synthetic Construct
tccatgaggcacagcgaagt

SEQ ID NO: 24780 - DNA, 21 bp, Artificial Sequence
  Synthetic Construct
cgtggaggacctaggctgaag

SEQ ID NO: 24781 - DNA, 21 bp, Artificial Sequence
  Synthetic Construct
aggcaccacgtacagaagcta

SEQ ID NO: 24782 - DNA, 23 bp, Artificial Sequence
  Synthetic Construct
ctcagtgtctgtgtctcatggtt

SEQ ID NO: 24783 - DNA, 27 bp, Artificial Sequence
  Synthetic Construct
gatccaagcattcctgctgataataga

SEQ ID NO: 24784 - DNA, 22 bp, Artificial Sequence
  Synthetic Construct
acctcatgccatctccccactt

SEQ ID NO: 24785 - DNA, 24 bp, Artificial Sequence
  Synthetic Construct
gcagaggcagttaagcaggaggta

SEQ ID NO: 24786 - DNA, 24 bp, Artificial Sequence
  Synthetic Construct
ccactgttccttagctatgtgagt

SEQ ID NO: 24787 - DNA, 20 bp, Artificial Sequence
  Synthetic Construct
tggctcagcctcccctttca

SEQ ID NO: 24788 - DNA, 22 bp, Artificial Sequence
  Synthetic Construct
aagccagggaggtctgcagcta

SEQ ID NO: 24789 - DNA, 22 bp, Artificial Sequence
  Synthetic Construct
gaaatctgcccagcaccagaca

SEQ ID NO: 24790 - DNA, 20 bp, Artificial Sequence
  Synthetic Construct
cccagcactgaactgacaca

SEQ ID NO: 24791 - DNA, 21 bp, Artificial Sequence
  Synthetic Construct
cgcccactctgaaccacgtaa

SEQ ID NO: 24792 - DNA, 21 bp, Artificial Sequence
  Synthetic Construct
actggagaagccgccatgtag

SEQ ID NO: 24793 - DNA, 22 bp, Artificial Sequence
  Synthetic Construct
gctgtctccttttctgccaaga

SEQ ID NO: 24794 - DNA, 20 bp, Artificial Sequence
  Synthetic Construct
gggaagcaggtagggagctt

SEQ ID NO: 24795 - DNA, 22 bp, Artificial Sequence
  Synthetic Construct
ggctgtgagaagcattgggaaa

SEQ ID NO: 24796 - DNA, 21 bp, Artificial Sequence
  Synthetic Construct
ggggctgggcaagtcttagaa

SEQ ID NO: 24797 - DNA, 19 bp, Artificial Sequence
  Synthetic Construct
ccccagaacgtggcctttg

SEQ ID NO: 24798 - DNA, 21 bp, Artificial Sequence
  Synthetic Construct
tgtccaaacctgccctgaaag

SEQ ID NO: 24799 - DNA, 19 bp, Artificial Sequence
  Synthetic Construct
tgggaggccagtgtgaagt

SEQ ID NO: 24800 - DNA, 25 bp, Artificial Sequence
  Synthetic Construct
cctcactcttcagggacaatagact

SEQ ID NO: 24801 - DNA, 23 bp, Artificial Sequence
  Synthetic Construct
ctgtagcgaagcctttggattct

SEQ ID NO: 24802 - DNA, 23 bp, Artificial Sequence
  Synthetic Construct
ctgaccaaggaactcacttcaca

SEQ ID NO: 24803 - DNA, 20 bp, Artificial Sequence
  Synthetic Construct
tgctgagccactgggataca

SEQ ID NO: 24804 - DNA, 25 bp, Artificial Sequence
  Synthetic Construct
gaagagtaagcagagagcaggttga

SEQ ID NO: 24805 - DNA, 21 bp, Artificial Sequence
  Synthetic Construct
gggaccacgaacgacacaact

SEQ ID NO: 24806 - DNA, 22 bp, Artificial Sequence
  Synthetic Construct
gcaggattgccaaactctgtgt

SEQ ID NO: 24807 - DNA, 21 bp, Artificial Sequence
  Synthetic Construct
cggcctggttccaacttctga

SEQ ID NO: 24808 - DNA, 22 bp, Artificial Sequence
  Synthetic Construct
gcaggtggcatgactggacttt

SEQ ID NO: 24809 - DNA, 24 bp, Artificial Sequence
  Synthetic Construct
ctttgttcaaaccctgagcccata

SEQ ID NO: 24810 - DNA, 22 bp, Artificial Sequence
  Synthetic Construct
tctgctatgctgctttctccaa

SEQ ID NO: 24811 - DNA, 24 bp, Artificial Sequence
  Synthetic Construct
gcccaatgaggaggaatgggatca

SEQ ID NO: 24812 - DNA, 19 bp, Artificial Sequence
  Synthetic Construct
aatgccgtgctgagtggaa

SEQ ID NO: 24813 - DNA, 21 bp, Artificial Sequence
  Synthetic Construct
gtgtgtgcttctggtctcgat

SEQ ID NO: 24814 - DNA, 23 bp, Artificial Sequence
  Synthetic Construct
ggaccctgagagtacctgcactt

SEQ ID NO: 24815 - DNA, 22 bp, Artificial Sequence
  Synthetic Construct
ctcgggtgcaattgggtctgaa

SEQ ID NO: 24816 - DNA, 23 bp, Artificial Sequence
  Synthetic Construct
gcactaaaaatgcctccttgcat

SEQ ID NO: 24817 - DNA, 20 bp, Artificial Sequence
  Synthetic Construct
tgggagggtaggagcgtgta

SEQ ID NO: 24818 - DNA, 22 bp, Artificial Sequence
  Synthetic Construct
agcttcaccagagtcacgtttc

SEQ ID NO: 24819 - DNA, 20 bp, Artificial Sequence
  Synthetic Construct
acaccagccatgcgcctaat

SEQ ID NO: 24820 - DNA, 22 bp, Artificial Sequence
  Synthetic Construct
cctacatgctacaagccaccat

SEQ ID NO: 24821 - DNA, 21 bp, Artificial Sequence
  Synthetic Construct
gctgtttacgtggctctgcat

SEQ ID NO: 24822 - DNA, 22 bp, Artificial Sequence
  Synthetic Construct
ggagtcacagctggtcctaatg

SEQ ID NO: 24823 - DNA, 19 bp, Artificial Sequence
  Synthetic Construct
ttcctggccagtgctgtgt

SEQ ID NO: 24824 - DNA, 20 bp, Artificial Sequence
  Synthetic Construct
cataggtcgggtgggtggaa

SEQ ID NO: 24825 - DNA, 22 bp, Artificial Sequence
  Synthetic Construct
ggcccctttccctgctcttatt

SEQ ID NO: 24826 - DNA, 19 bp, Artificial Sequence
  Synthetic Construct
ggccagtgggcctgtttga

SEQ ID NO: 24827 - DNA, 22 bp, Artificial Sequence
  Synthetic Construct
gcaagaaacaggttggttgtgt

SEQ ID NO: 24828 - DNA, 23 bp, Artificial Sequence
  Synthetic Construct
agagaagccattcacaagctgat

SEQ ID NO: 24829 - DNA, 22 bp, Artificial Sequence
  Synthetic Construct
ggccagacaaaggcaggacatt

SEQ ID NO: 24830 - DNA, 22 bp, Artificial Sequence
  Synthetic Construct
cagccttgccctgtgtcatact

SEQ ID NO: 24831 - DNA, 22 bp, Artificial Sequence
  Synthetic Construct
cccagagtggttcagagagcta

SEQ ID NO: 24832 - DNA, 23 bp, Artificial Sequence
  Synthetic Construct
gaagccaggaaatgacgtaggat

SEQ ID NO: 24833 - DNA, 20 bp, Artificial Sequence
  Synthetic Construct
cacacggtggatcagccttt

SEQ ID NO: 24834 - DNA, 21 bp, Artificial Sequence
  Synthetic Construct
gcgctccagggattttgattg

SEQ ID NO: 24835 - DNA, 20 bp, Artificial Sequence
  Synthetic Construct
atctgggccccttcttctga

SEQ ID NO: 24836 - DNA, 23 bp, Artificial Sequence
  Synthetic Construct
ttcctgctacctcttctcctcaa

SEQ ID NO: 24837 - DNA, 22 bp, Artificial Sequence
  Synthetic Construct
cctcctgatggactgccaggta

SEQ ID NO: 24838 - DNA, 22 bp, Artificial Sequence
  Synthetic Construct
gacgggcgtttgttctccttga

SEQ ID NO: 24839 - DNA, 21 bp, Artificial Sequence
  Synthetic Construct
tgcagtactggagaggtgcat

SEQ ID NO: 24840 - DNA, 18 bp, Artificial Sequence
  Synthetic Construct
tgctggtgcgaggagaga

SEQ ID NO: 24841 - DNA, 22 bp, Artificial Sequence
  Synthetic Construct
gacagccccaacacttcactct

SEQ ID NO: 24842 - DNA, 22 bp, Artificial Sequence
  Synthetic Construct
atccatctcctgctcccgtttc

SEQ ID NO: 24843 - DNA, 24 bp, Artificial Sequence
  Synthetic Construct
gcttggtgtgttactgaacctcta

SEQ ID NO: 24844 - DNA, 23 bp, Artificial Sequence
  Synthetic Construct
caagttccttcagtgaggccatt

SEQ ID NO: 24845 - DNA, 22 bp, Artificial Sequence
  Synthetic Construct
gctgcaagcaagagaccatttc

SEQ ID NO: 24846 - DNA, 20 bp, Artificial Sequence
  Synthetic Construct
tggcttccccagaaggacaa

SEQ ID NO: 24847 - DNA, 23 bp, Artificial Sequence
  Synthetic Construct
ggaaatgtgtgtctcccaaccat

SEQ ID NO: 24848 - DNA, 22 bp, Artificial Sequence
  Synthetic Construct
cctctcctgttccggagtgttc

SEQ ID NO: 24849 - DNA, 22 bp, Artificial Sequence
  Synthetic Construct
gcagtagcgacttacccacagt

SEQ ID NO: 24850 - DNA, 23 bp, Artificial Sequence
  Synthetic Construct
cctccttgcaatcagctttggta

SEQ ID NO: 24851 - DNA, 25 bp, Artificial Sequence
  Synthetic Construct
gtagacttactctgaagtccacgtt

SEQ ID NO: 24852 - DNA, 24 bp, Artificial Sequence
  Synthetic Construct
gatgaatgggatggtgacctttct

SEQ ID NO: 24853 - DNA, 21 bp, Artificial Sequence
  Synthetic Construct
cggaggcccctctaagtcagt

SEQ ID NO: 24854 - DNA, 20 bp, Artificial Sequence
  Synthetic Construct
agtggtcacctggggcagat

SEQ ID NO: 24855 - DNA, 23 bp, Artificial Sequence
  Synthetic Construct
tgggacatagagtgacaggactt

SEQ ID NO: 24856 - DNA, 20 bp, Artificial Sequence
  Synthetic Construct
acaggagccaaaccggtact

SEQ ID NO: 24857 - DNA, 27 bp, Artificial Sequence
  Synthetic Construct
gaccaccaatttcagtagggttttatg

SEQ ID NO: 24858 - DNA, 22 bp, Artificial Sequence
  Synthetic Construct
caggaaggaagcgatgaactga

SEQ ID NO: 24859 - DNA, 20 bp, Artificial Sequence
  Synthetic Construct
agcagggattggcgaagaca

SEQ ID NO: 24860 - DNA, 22 bp, Artificial Sequence
  Synthetic Construct
ggccagttgctttcaccaatgt

SEQ ID NO: 24861 - DNA, 24 bp, Artificial Sequence
  Synthetic Construct
gtgctccctttgaagaactggatt

SEQ ID NO: 24862 - DNA, 21 bp, Artificial Sequence
  Synthetic Construct
tgtggagaaggggtcctcatt

SEQ ID NO: 24863 - DNA, 24 bp, Artificial Sequence
  Synthetic Construct
gctgccatcagcttttctgtcgat

SEQ ID NO: 24864 - DNA, 22 bp, Artificial Sequence
  Synthetic Construct
ggatcagcatggagacaaccaa

SEQ ID NO: 24865 - DNA, 20 bp, Artificial Sequence
  Synthetic Construct
cagtgggctcaccgtagctt

SEQ ID NO: 24866 - DNA, 26 bp, Artificial Sequence
  Synthetic Construct
cggattgttttccaggtacaaagtgt

SEQ ID NO: 24867 - DNA, 25 bp, Artificial Sequence
  Synthetic Construct
gttccttttgagcaggcttgtctat

SEQ ID NO: 24868 - DNA, 22 bp, Artificial Sequence
  Synthetic Construct
cagatggggagaactgctcaca

SEQ ID NO: 24869 - DNA, 24 bp, Artificial Sequence
  Synthetic Construct
gcaaggagcaatgaacagctacta

SEQ ID NO: 24870 - DNA, 22 bp, Artificial Sequence
  Synthetic Construct
ttcacagggaggactggagtta

SEQ ID NO: 24871 - DNA, 24 bp, Artificial Sequence
  Synthetic Construct
agacagtagccagcttcaaaaact

SEQ ID NO: 24872 - DNA, 26 bp, Artificial Sequence
  Synthetic Construct
cacaacatcactgcatctgcattcta

SEQ ID NO: 24873 - DNA, 21 bp, Artificial Sequence
  Synthetic Construct
aagccaccctgggaaccacat

SEQ ID NO: 24874 - DNA, 23 bp, Artificial Sequence
  Synthetic Construct
tggggtaggaggaggacacagta

SEQ ID NO: 24875 - DNA, 21 bp, Artificial Sequence
  Synthetic Construct
ggaagccatcagcatgtggaa

SEQ ID NO: 24876 - DNA, 20 bp, Artificial Sequence
  Synthetic Construct
ccccaaccaacctgcacaca

SEQ ID NO: 24877 - DNA, 21 bp, Artificial Sequence
  Synthetic Construct
agccccagttcactgttgatg

SEQ ID NO: 24878 - DNA, 21 bp, Artificial Sequence
  Synthetic Construct
gaatcacccatgcagctggta

SEQ ID NO: 24879 - DNA, 22 bp, Artificial Sequence
  Synthetic Construct
ccctattgtgccccagatttga

SEQ ID NO: 24880 - DNA, 22 bp, Artificial Sequence
  Synthetic Construct
ctccttgcacagaagggctcat

SEQ ID NO: 24881 - DNA, 22 bp, Artificial Sequence
  Synthetic Construct
gcgtgctacatctccactgaca

SEQ ID NO: 24882 - DNA, 22 bp, Artificial Sequence
  Synthetic Construct
gaacatcctggggtgcacaaag

SEQ ID NO: 24883 - DNA, 21 bp, Artificial Sequence
  Synthetic Construct
ccttcagggtcctgcagttca

SEQ ID NO: 24884 - DNA, 21 bp, Artificial Sequence
  Synthetic Construct
accatgcagggacacacaatg

SEQ ID NO: 24885 - DNA, 22 bp, Artificial Sequence
  Synthetic Construct
cacagaagcgcatcaaggttac

SEQ ID NO: 24886 - DNA, 20 bp, Artificial Sequence
  Synthetic Construct
cctgccagaaggcgtaagaa

SEQ ID NO: 24887 - DNA, 25 bp, Artificial Sequence
  Synthetic Construct
gagtaagccccatttaggctttcaa

SEQ ID NO: 24888 - DNA, 21 bp, Artificial Sequence
  Synthetic Construct
agatgcagccaggtagagact

SEQ ID NO: 24889 - DNA, 21 bp, Artificial Sequence
  Synthetic Construct
cccgggtgtctgtcgagtaac

SEQ ID NO: 24890 - DNA, 20 bp, Artificial Sequence
  Synthetic Construct
gcagtggggcattgtgaatc

SEQ ID NO: 24891 - DNA, 22 bp, Artificial Sequence
  Synthetic Construct
gggttcctgcgttggggtattt

SEQ ID NO: 24892 - DNA, 20 bp, Artificial Sequence
  Synthetic Construct
tgccagaagccagtgccaat

SEQ ID NO: 24893 - DNA, 21 bp, Artificial Sequence
  Synthetic Construct
gcagcaagccaggaaagacaa

SEQ ID NO: 24894 - DNA, 20 bp, Artificial Sequence
  Synthetic Construct
agccacctgcaagtcaggaa

SEQ ID NO: 24895 - DNA, 24 bp, Artificial Sequence
  Synthetic Construct
ttagtcttctctctgccaggaaac

SEQ ID NO: 24896 - DNA, 20 bp, Artificial Sequence
  Synthetic Construct
ggtttgcaccctgggaatga

SEQ ID NO: 24897 - DNA, 24 bp, Artificial Sequence
  Synthetic Construct
tggggagaaagtcagtatccaact

SEQ ID NO: 24898 - DNA, 25 bp, Artificial Sequence
  Synthetic Construct
caggacttctcacagcctttaatgt

SEQ ID NO: 24899 - DNA, 24 bp, Artificial Sequence
  Synthetic Construct
ggtatcagtgctgcttagccattg

SEQ ID NO: 24900 - DNA, 22 bp, Artificial Sequence
  Synthetic Construct
ctgtcagaaccagcaagcatgt

SEQ ID NO: 24901 - DNA, 19 bp, Artificial Sequence
  Synthetic Construct
tccccagctccaggcagta

SEQ ID NO: 24902 - DNA, 22 bp, Artificial Sequence
  Synthetic Construct
catgggctgagctgaagataca

SEQ ID NO: 24903 - DNA, 22 bp, Artificial Sequence
  Synthetic Construct
gggaagtagaaaccgccaatct

SEQ ID NO: 24904 - DNA, 22 bp, Artificial Sequence
  Synthetic Construct
cggattgtggctctctgtgact

SEQ ID NO: 24905 - DNA, 22 bp, Artificial Sequence
  Synthetic Construct
caccgactcctcgccattatct

SEQ ID NO: 24906 - DNA, 21 bp, Artificial Sequence
  Synthetic Construct
tacctggtccagcctgacttc

SEQ ID NO: 24907 - DNA, 22 bp, Artificial Sequence
  Synthetic Construct
cccgttggactcagaagtgaag

SEQ ID NO: 24908 - DNA, 20 bp, Artificial Sequence
  Synthetic Construct
cctgcccactctcagcagat

SEQ ID NO: 24909 - DNA, 22 bp, Artificial Sequence
  Synthetic Construct
cagctaccctttgcctctgcat

SEQ ID NO: 24910 - DNA, 23 bp, Artificial Sequence
  Synthetic Construct
gacttcccctcaggtcttttcaa

SEQ ID NO: 24911 - DNA, 24 bp, Artificial Sequence
  Synthetic Construct
gcctggatacagggacacctattc

SEQ ID NO: 24912 - DNA, 24 bp, Artificial Sequence
  Synthetic Construct
gaagctgatgaaacagtcctctca

SEQ ID NO: 24913 - DNA, 21 bp, Artificial Sequence
  Synthetic Construct
actaccctgaggctgatccaa

SEQ ID NO: 24914 - DNA, 21 bp, Artificial Sequence
  Synthetic Construct
gtggaacctggtggactcctt

SEQ ID NO: 24915 - DNA, 23 bp, Artificial Sequence
  Synthetic Construct
gacattgagcgggtcacttaaac

SEQ ID NO: 24916 - DNA, 25 bp, Artificial Sequence
  Synthetic Construct
tggttgctccagaaactacctaaat

SEQ ID NO: 24917 - DNA, 21 bp, Artificial Sequence
  Synthetic Construct
aagactggggacgggatactt

SEQ ID NO: 24918 - DNA, 19 bp, Artificial Sequence
  Synthetic Construct
gccgagactgccagacctt

SEQ ID NO: 24919 - DNA, 24 bp, Artificial Sequence
  Synthetic Construct
gtgtccgaggaagtgtgacaaatg

SEQ ID NO: 24920 - DNA, 24 bp, Artificial Sequence
  Synthetic Construct
gtgattcctatgggcttcccactt

SEQ ID NO: 24921 - DNA, 19 bp, Artificial Sequence
  Synthetic Construct
gcccaccctcccacattac

SEQ ID NO: 24922 - DNA, 20 bp, Artificial Sequence
  Synthetic Construct
ggaacaccctctggcactct

SEQ ID NO: 24923 - DNA, 22 bp, Artificial Sequence
  Synthetic Construct
agtggaacagttgcctgagatg

SEQ ID NO: 24924 - DNA, 25 bp, Artificial Sequence
  Synthetic Construct
cacgtgtgtaagtgcagactctttg

SEQ ID NO: 24925 - DNA, 23 bp, Artificial Sequence
  Synthetic Construct
cccaaggcaatgacaaatgctta

SEQ ID NO: 24926 - DNA, 20 bp, Artificial Sequence
  Synthetic Construct
tgaaggctcaggcacagaca

SEQ ID NO: 24927 - DNA, 21 bp, Artificial Sequence
  Synthetic Construct
tgcccctcaactctgcatttc

SEQ ID NO: 24928 - DNA, 20 bp, Artificial Sequence
  Synthetic Construct
tggcagctctctcagcatca

SEQ ID NO: 24929 - DNA, 20 bp, Artificial Sequence
  Synthetic Construct
tctcgccaaatgccgtggaa

SEQ ID NO: 24930 - DNA, 20 bp, Artificial Sequence
  Synthetic Construct
gccattggccagcattgact

SEQ ID NO: 24931 - DNA, 26 bp, Artificial Sequence
  Synthetic Construct
ggctgactatatgcttctgctgaact

SEQ ID NO: 24932 - DNA, 20 bp, Artificial Sequence
  Synthetic Construct
ggcaggagcccctcttcttg

SEQ ID NO: 24933 - DNA, 23 bp, Artificial Sequence
  Synthetic Construct
caaggtaacaccccaagatgtga

SEQ ID NO: 24934 - DNA, 28 bp, Artificial Sequence
  Synthetic Construct
cctaagcgtcctaaatgaggtaagaatg

SEQ ID NO: 24935 - DNA, 27 bp, Artificial Sequence
  Synthetic Construct
gccatctgaaaactgtgatggagttag

SEQ ID NO: 24936 - DNA, 24 bp, Artificial Sequence
  Synthetic Construct
cggtctctgatgttctcggacgtt

SEQ ID NO: 24937 - DNA, 20 bp, Artificial Sequence
  Synthetic Construct
accatgacacgcccttgact

SEQ ID NO: 24938 - DNA, 23 bp, Artificial Sequence
  Synthetic Construct
cctggctgggcataagtttttgt

SEQ ID NO: 24939 - DNA, 24 bp, Artificial Sequence
  Synthetic Construct
ctgaaaggaagaagccacagtcaa

SEQ ID NO: 24940 - DNA, 20 bp, Artificial Sequence
  Synthetic Construct
cccagtgcttgtggactctt

SEQ ID NO: 24941 - DNA, 21 bp, Artificial Sequence
  Synthetic Construct
ggtgccttctggcatcagcat

SEQ ID NO: 24942 - DNA, 21 bp, Artificial Sequence
  Synthetic Construct
catgggcctccaggacctact

SEQ ID NO: 24943 - DNA, 20 bp, Artificial Sequence
  Synthetic Construct
cacctgccttccccatgagt

SEQ ID NO: 24944 - DNA, 22 bp, Artificial Sequence
  Synthetic Construct
caaggaggaccctggcttttca

SEQ ID NO: 24945 - DNA, 22 bp, Artificial Sequence
  Synthetic Construct
cctcccgcaactcttctgctta

SEQ ID NO: 24946 - DNA, 24 bp, Artificial Sequence
  Synthetic Construct
ggatctcagggctcacctgtgaaa

SEQ ID NO: 24947 - DNA, 21 bp, Artificial Sequence
  Synthetic Construct
gcacttcccctcacagtcaga

SEQ ID NO: 24948 - DNA, 19 bp, Artificial Sequence
  Synthetic Construct
gccgcacaggatggggaaa

SEQ ID NO: 24949 - DNA, 22 bp, Artificial Sequence
  Synthetic Construct
accacaggctacctttccaatc

SEQ ID NO: 24950 - DNA, 21 bp, Artificial Sequence
  Synthetic Construct
cactatgcagccagaccatca

SEQ ID NO: 24951 - DNA, 23 bp, Artificial Sequence
  Synthetic Construct
ccccaggcattggtccttaatgt

SEQ ID NO: 24952 - DNA, 21 bp, Artificial Sequence
  Synthetic Construct
atcacgtgaccacccctcgta

SEQ ID NO: 24953 - DNA, 25 bp, Artificial Sequence
  Synthetic Construct
gctgtgttaatggagctacaatgtt

SEQ ID NO: 24954 - DNA, 22 bp, Artificial Sequence
  Synthetic Construct
gcagaaaaccctggcacacaga

SEQ ID NO: 24955 - DNA, 19 bp, Artificial Sequence
  Synthetic Construct
gtctggctcgggaccactt

SEQ ID NO: 24956 - DNA, 21 bp, Artificial Sequence
  Synthetic Construct
gcctccgagttgtttgagagt

SEQ ID NO: 24957 - DNA, 22 bp, Artificial Sequence
  Synthetic Construct
tctaggacgtggtctccacctt

SEQ ID NO: 24958 - DNA, 21 bp, Artificial Sequence
  Synthetic Construct
tggccatatgccgagctaaaa

SEQ ID NO: 24959 - DNA, 24 bp, Artificial Sequence
  Synthetic Construct
cagagcctgaatgatttccacact

SEQ ID NO: 24960 - DNA, 19 bp, Artificial Sequence
  Synthetic Construct
gccatcagtggctcagctt

SEQ ID NO: 24961 - DNA, 26 bp, Artificial Sequence
  Synthetic Construct
tgctaactgacttacccaatccatag

SEQ ID NO: 24962 - DNA, 24 bp, Artificial Sequence
  Synthetic Construct
tgggctcttgtctcagtgtattct

SEQ ID NO: 24963 - DNA, 24 bp, Artificial Sequence
  Synthetic Construct
gcctccatcccttttctcagagtt

SEQ ID NO: 24964 - DNA, 23 bp, Artificial Sequence
  Synthetic Construct
ctacacttgtggagctgtctgaa

SEQ ID NO: 24965 - DNA, 24 bp, Artificial Sequence
  Synthetic Construct
cacacccacagattcgagaaggat

SEQ ID NO: 24966 - DNA, 22 bp, Artificial Sequence
  Synthetic Construct
aggcactgagacgaggacaagt

SEQ ID NO: 24967 - DNA, 20 bp, Artificial Sequence
  Synthetic Construct
gtccgtcaccttgggagtca

SEQ ID NO: 24968 - DNA, 20 bp, Artificial Sequence
  Synthetic Construct
aaggccggtggtctcttcaa

SEQ ID NO: 24969 - DNA, 25 bp, Artificial Sequence
  Synthetic Construct
caactgcagagagcagagttcacta

SEQ ID NO: 24970 - DNA, 20 bp, Artificial Sequence
  Synthetic Construct
atccaggtcaggccacagtt

SEQ ID NO: 24971 - DNA, 20 bp, Artificial Sequence
  Synthetic Construct
tccagcaacgtgaccaaaca

SEQ ID NO: 24972 - DNA, 21 bp, Artificial Sequence
  Synthetic Construct
gcctggaggtgaggtgtgttt

SEQ ID NO: 24973 - DNA, 20 bp, Artificial Sequence
  Synthetic Construct
agttgccctgaagcgtggat

SEQ ID NO: 24974 - DNA, 21 bp, Artificial Sequence
  Synthetic Construct
tcagggtgccaacctatgcta

SEQ ID NO: 24975 - DNA, 26 bp, Artificial Sequence
  Synthetic Construct
ggttagccagtcagaactttgtttac

SEQ ID NO: 24976 - DNA, 21 bp, Artificial Sequence
  Synthetic Construct
cacagtaccaaaggccagaca

SEQ ID NO: 24977 - DNA, 22 bp, Artificial Sequence
  Synthetic Construct
ctgccctggaagactggaaaga

SEQ ID NO: 24978 - DNA, 20 bp, Artificial Sequence
  Synthetic Construct
tgcaccaatgaagccacaca

SEQ ID NO: 24979 - DNA, 23 bp, Artificial Sequence
  Synthetic Construct
gaggctggccagatgttttctca

SEQ ID NO: 24980 - DNA, 21 bp, Artificial Sequence
  Synthetic Construct
atccctgcagccagaggttca

SEQ ID NO: 24981 - DNA, 24 bp, Artificial Sequence
  Synthetic Construct
tggtggagaggggaatacactaac

SEQ ID NO: 24982 - DNA, 23 bp, Artificial Sequence
  Synthetic Construct
tggatctgacttggagagcattg

SEQ ID NO: 24983 - DNA, 27 bp, Artificial Sequence
  Synthetic Construct
actcatgggtacagaggattataggaa

SEQ ID NO: 24984 - DNA, 19 bp, Artificial Sequence
  Synthetic Construct
cccctctgcttgccacagt

SEQ ID NO: 24985 - DNA, 23 bp, Artificial Sequence
  Synthetic Construct
ctctgcggtcccatttctgaaca

SEQ ID NO: 24986 - DNA, 20 bp, Artificial Sequence
  Synthetic Construct
cacttccccaaccccactct

SEQ ID NO: 24987 - DNA, 21 bp, Artificial Sequence
  Synthetic Construct
ggggccaagtgactaagttgt

SEQ ID NO: 24988 - DNA, 20 bp, Artificial Sequence
  Synthetic Construct
ttgctgggcccctctgtttg

SEQ ID NO: 24989 - DNA, 23 bp, Artificial Sequence
  Synthetic Construct
ccacaccttccttctccttccaa

SEQ ID NO: 24990 - DNA, 22 bp, Artificial Sequence
  Synthetic Construct
ctcacaggctgcctctctaatc

SEQ ID NO: 24991 - DNA, 24 bp, Artificial Sequence
  Synthetic Construct
ggaaggaggtcgctttcaaaatca

SEQ ID NO: 24992 - DNA, 22 bp, Artificial Sequence
  Synthetic Construct
cccacttgcagaagaggtgcat

SEQ ID NO: 24993 - DNA, 21 bp, Artificial Sequence
  Synthetic Construct
ggacaggggctctgagacaca

SEQ ID NO: 24994 - DNA, 24 bp, Artificial Sequence
  Synthetic Construct
gagaaatgcaaggactccacaaaa

SEQ ID NO: 24995 - DNA, 26 bp, Artificial Sequence
  Synthetic Construct
gttgatcctatagtgcgaacctgaca

SEQ ID NO: 24996 - DNA, 24 bp, Artificial Sequence
  Synthetic Construct
cgcaatgacagctccattactaac

SEQ ID NO: 24997 - DNA, 23 bp, Artificial Sequence
  Synthetic Construct
ccttctctgcaagtgtggtgtca

SEQ ID NO: 24998 - DNA, 22 bp, Artificial Sequence
  Synthetic Construct
cccagtgggatgatgctagatg

SEQ ID NO: 24999 - DNA, 21 bp, Artificial Sequence
  Synthetic Construct
gaggcctggcaatttctgctt

SEQ ID NO: 25000 - DNA, 23 bp, Artificial Sequence
  Synthetic Construct
tccaaaagctcttgatgctgaca

SEQ ID NO: 25001 - DNA, 24 bp, Artificial Sequence
  Synthetic Construct
ctctgttctatctgccacaaggtt

SEQ ID NO: 25002 - DNA, 23 bp, Artificial Sequence
  Synthetic Construct
gacaccagttcaccccagttatc

SEQ ID NO: 25003 - DNA, 20 bp, Artificial Sequence
  Synthetic Construct
gggcaatgcctggagctagt

SEQ ID NO: 25004 - DNA, 19 bp, Artificial Sequence
  Synthetic Construct
gcagcagctcctgtctgat

SEQ ID NO: 25005 - DNA, 20 bp, Artificial Sequence
  Synthetic Construct
gccctcgctgtggcttatga

SEQ ID NO: 25006 - DNA, 22 bp, Artificial Sequence
  Synthetic Construct
ggtggacaaggtggaaaagtct

SEQ ID NO: 25007 - DNA, 19 bp, Artificial Sequence
  Synthetic Construct
aacagaggcaccgccaagt

SEQ ID NO: 25008 - DNA, 23 bp, Artificial Sequence
  Synthetic Construct
gggttcctccatccccttcacat

SEQ ID NO: 25009 - DNA, 24 bp, Artificial Sequence
  Synthetic Construct
tcacccatcccacctatttacttg

SEQ ID NO: 25010 - DNA, 23 bp, Artificial Sequence
  Synthetic Construct
gttacagtctcggtcacgtcttg

SEQ ID NO: 25011 - DNA, 23 bp, Artificial Sequence
  Synthetic Construct
cacagtgcacatgaaccccttct

SEQ ID NO: 25012 - DNA, 20 bp, Artificial Sequence
  Synthetic Construct
accccacagctgggctttag

SEQ ID NO: 25013 - DNA, 22 bp, Artificial Sequence
  Synthetic Construct
ggggtgcgcttgaagcttatgt

SEQ ID NO: 25014 - DNA, 24 bp, Artificial Sequence
  Synthetic Construct
gccttggagaatccttccttaact

SEQ ID NO: 25015 - DNA, 22 bp, Artificial Sequence
  Synthetic Construct
ccaagagcctggtgagtacgtt

SEQ ID NO: 25016 - DNA, 24 bp, Artificial Sequence
  Synthetic Construct
gaagttctactctgtgctggtgaa

SEQ ID NO: 25017 - DNA, 25 bp, Artificial Sequence
  Synthetic Construct
gagaactgccggatcaaacagaaag

SEQ ID NO: 25018 - DNA, 21 bp, Artificial Sequence
  Synthetic Construct
cggtagtgcaggggattgtca

SEQ ID NO: 25019 - DNA, 25 bp, Artificial Sequence
  Synthetic Construct
ggagaacaccagggagaacacatag

SEQ ID NO: 25020 - DNA, 26 bp, Artificial Sequence
  Synthetic Construct
gagtagatcagtggctgttacctgaa

SEQ ID NO: 25021 - DNA, 22 bp, Artificial Sequence
  Synthetic Construct
aggcaccaggagagagtgtatt

SEQ ID NO: 25022 - DNA, 20 bp, Artificial Sequence
  Synthetic Construct
aagtcggagttggcgtcctt

SEQ ID NO: 25023 - DNA, 20 bp, Artificial Sequence
  Synthetic Construct
acacctccctgaccctgcat

SEQ ID NO: 25024 - DNA, 24 bp, Artificial Sequence
  Synthetic Construct
agagggtaagggctatttgaggaa

SEQ ID NO: 25025 - DNA, 22 bp, Artificial Sequence
  Synthetic Construct
caaccagctctaagctctgaca

SEQ ID NO: 25026 - DNA, 23 bp, Artificial Sequence
  Synthetic Construct
tcctgttccatcactgattcgtt

SEQ ID NO: 25027 - DNA, 21 bp, Artificial Sequence
  Synthetic Construct
gggtgacagcaaagaggttga

SEQ ID NO: 25028 - DNA, 22 bp, Artificial Sequence
  Synthetic Construct
tggcagacagatgaggtagtgt

SEQ ID NO: 25029 - DNA, 20 bp, Artificial Sequence
  Synthetic Construct
ggggtcctaggcagcactga

SEQ ID NO: 25030 - DNA, 19 bp, Artificial Sequence
  Synthetic Construct
tccccaccccatgcaggta

SEQ ID NO: 25031 - DNA, 24 bp, Artificial Sequence
  Synthetic Construct
gcagggtggagagataccactctt

SEQ ID NO: 25032 - DNA, 22 bp, Artificial Sequence
  Synthetic Construct
cttcctccccacctcctaagaa

SEQ ID NO: 25033 - DNA, 23 bp, Artificial Sequence
  Synthetic Construct
aatgaggctgggacaatcaagaa

SEQ ID NO: 25034 - DNA, 23 bp, Artificial Sequence
  Synthetic Construct
gctgcataaagggcattgcttca

SEQ ID NO: 25035 - DNA, 25 bp, Artificial Sequence
  Synthetic Construct
ccccaggagagcgaataatcacaag

SEQ ID NO: 25036 - DNA, 22 bp, Artificial Sequence
  Synthetic Construct
tccctgattccccaaggcttct

SEQ ID NO: 25037 - DNA, 23 bp, Artificial Sequence
  Synthetic Construct
gcctgggagatggctgttagtag

SEQ ID NO: 25038 - DNA, 20 bp, Artificial Sequence
  Synthetic Construct
catggcctcagcacagtgaa

SEQ ID NO: 25039 - DNA, 21 bp, Artificial Sequence
  Synthetic Construct
cctcatgccggatgctcttct

SEQ ID NO: 25040 - DNA, 23 bp, Artificial Sequence
  Synthetic Construct
gtgggccatgggtagttatggaa

SEQ ID NO: 25041 - DNA, 22 bp, Artificial Sequence
  Synthetic Construct
ctgccttctggccccatctaat

SEQ ID NO: 25042 - DNA, 21 bp, Artificial Sequence
  Synthetic Construct
agggatttgcgggactaccat

SEQ ID NO: 25043 - DNA, 22 bp, Artificial Sequence
  Synthetic Construct
caaagtggagggcctaggcaaa

SEQ ID NO: 25044 - DNA, 26 bp, Artificial Sequence
  Synthetic Construct
ctgcgtaagggagaaggataatttgt

SEQ ID NO: 25045 - DNA, 20 bp, Artificial Sequence
  Synthetic Construct
agagagcctggcctcagaca

SEQ ID NO: 25046 - DNA, 21 bp, Artificial Sequence
  Synthetic Construct
ctccttcaccgttagcagcaa

SEQ ID NO: 25047 - DNA, 25 bp, Artificial Sequence
  Synthetic Construct
ggatcaggaggttcaatgctaccaa

SEQ ID NO: 25048 - DNA, 20 bp, Artificial Sequence
  Synthetic Construct
ctgttgccttggccatcagt

SEQ ID NO: 25049 - DNA, 22 bp, Artificial Sequence
  Synthetic Construct
gggaatgtctgcgattggctat

SEQ ID NO: 25050 - DNA, 21 bp, Artificial Sequence
  Synthetic Construct
ggtcccgaatgctttctgtct

SEQ ID NO: 25051 - DNA, 21 bp, Artificial Sequence
  Synthetic Construct
ggccggaaaaggctacagtga

SEQ ID NO: 25052 - DNA, 23 bp, Artificial Sequence
  Synthetic Construct
gctcagcagaatcatgcctaaac

SEQ ID NO: 25053 - DNA, 22 bp, Artificial Sequence
  Synthetic Construct
cttggagcactgaagcatctca

SEQ ID NO: 25054 - DNA, 22 bp, Artificial Sequence
  Synthetic Construct
gaactgtcactgacccggttgt

SEQ ID NO: 25055 - DNA, 21 bp, Artificial Sequence
  Synthetic Construct
caccaggtgagggaagtcaca

SEQ ID NO: 25056 - DNA, 20 bp, Artificial Sequence
  Synthetic Construct
ttcccaggggctgtatgcaa

SEQ ID NO: 25057 - DNA, 19 bp, Artificial Sequence
  Synthetic Construct
tggccgtgcttggcttgtt

SEQ ID NO: 25058 - DNA, 24 bp, Artificial Sequence
  Synthetic Construct
gaggggaagacacatgccatcaaa

SEQ ID NO: 25059 - DNA, 23 bp, Artificial Sequence
  Synthetic Construct
caggtgacccgctaggatctatg

SEQ ID NO: 25060 - DNA, 20 bp, Artificial Sequence
  Synthetic Construct
gtggcatctggacacccatt

SEQ ID NO: 25061 - DNA, 22 bp, Artificial Sequence
  Synthetic Construct
ggggagccttgactgtaggaaa

SEQ ID NO: 25062 - DNA, 22 bp, Artificial Sequence
  Synthetic Construct
cacagcggtctaggctcatatt

SEQ ID NO: 25063 - DNA, 22 bp, Artificial Sequence
  Synthetic Construct
gcacaggagtcatcttgcatgt

SEQ ID NO: 25064 - DNA, 25 bp, Artificial Sequence
  Synthetic Construct
tgcttggttgtaatctgagagtgaa

SEQ ID NO: 25065 - DNA, 22 bp, Artificial Sequence
  Synthetic Construct
accatgggtccagtgggtaaag

SEQ ID NO: 25066 - DNA, 21 bp, Artificial Sequence
  Synthetic Construct
gcagcaggactctcaccttga

SEQ ID NO: 25067 - DNA, 23 bp, Artificial Sequence
  Synthetic Construct
cccttaccttccaagagctgtca

SEQ ID NO: 25068 - DNA, 24 bp, Artificial Sequence
  Synthetic Construct
gaacaacccaggctctgttatagt

SEQ ID NO: 25069 - DNA, 21 bp, Artificial Sequence
  Synthetic Construct
gttttgcccctagcaccaagt

SEQ ID NO: 25070 - DNA, 20 bp, Artificial Sequence
  Synthetic Construct
atggtggcactggactggaa

SEQ ID NO: 25071 - DNA, 19 bp, Artificial Sequence
  Synthetic Construct
caggcctgcacgtcacaga

SEQ ID NO: 25072 - DNA, 24 bp, Artificial Sequence
  Synthetic Construct
ttacctccagtggccctaattttt

SEQ ID NO: 25073 - DNA, 22 bp, Artificial Sequence
  Synthetic Construct
cccatcccaccttcctgtgata

SEQ ID NO: 25074 - DNA, 27 bp, Artificial Sequence
  Synthetic Construct
ggatttttgtccaggaggaagatgtca

SEQ ID NO: 25075 - DNA, 21 bp, Artificial Sequence
  Synthetic Construct
cttccccgaccactgctattc

SEQ ID NO: 25076 - DNA, 22 bp, Artificial Sequence
  Synthetic Construct
aaatcagcgtcctctcttgctt

SEQ ID NO: 25077 - DNA, 22 bp, Artificial Sequence
  Synthetic Construct
gtccctgtttcatgctgacctt

SEQ ID NO: 25078 - DNA, 21 bp, Artificial Sequence
  Synthetic Construct
ggagccagaagattgctcctt

SEQ ID NO: 25079 - DNA, 18 bp, Artificial Sequence
  Synthetic Construct
aaagccaggcacgccatt

SEQ ID NO: 25080 - DNA, 24 bp, Artificial Sequence
  Synthetic Construct
ggataatggacatcctgggaacaa

SEQ ID NO: 25081 - DNA, 20 bp, Artificial Sequence
  Synthetic Construct
aatattgccccggcttccaa

SEQ ID NO: 25082 - DNA, 22 bp, Artificial Sequence
  Synthetic Construct
cgatcccactgccaactcttct

SEQ ID NO: 25083 - DNA, 23 bp, Artificial Sequence
  Synthetic Construct
ggtatcagccccacattctctct

SEQ ID NO: 25084 - DNA, 24 bp, Artificial Sequence
  Synthetic Construct
ggagggtttggggaaatgacttct

SEQ ID NO: 25085 - DNA, 22 bp, Artificial Sequence
  Synthetic Construct
acccatctgccttatggtgact

SEQ ID NO: 25086 - DNA, 23 bp, Artificial Sequence
  Synthetic Construct
ggagtagccctgtatgagacttg

SEQ ID NO: 25087 - DNA, 22 bp, Artificial Sequence
  Synthetic Construct
gcagggtaggctgtggagatac

SEQ ID NO: 25088 - DNA, 22 bp, Artificial Sequence
  Synthetic Construct
ctgccacttgggtggtatactt

SEQ ID NO: 25089 - DNA, 23 bp, Artificial Sequence
  Synthetic Construct
gggcccatcccatcaaaaaggat

SEQ ID NO: 25090 - DNA, 20 bp, Artificial Sequence
  Synthetic Construct
aacagggaagccccttgttg

SEQ ID NO: 25091 - DNA, 20 bp, Artificial Sequence
  Synthetic Construct
cctggcttccccttctcaag

SEQ ID NO: 25092 - DNA, 19 bp, Artificial Sequence
  Synthetic Construct
cccctgcctacgctactct

SEQ ID NO: 25093 - DNA, 23 bp, Artificial Sequence
  Synthetic Construct
ctctgatcagcgtccctagtttg

SEQ ID NO: 25094 - DNA, 21 bp, Artificial Sequence
  Synthetic Construct
ccaggtcgccattggcagtat

SEQ ID NO: 25095 - DNA, 24 bp, Artificial Sequence
  Synthetic Construct
gagagactcaaaccgctagacctt

SEQ ID NO: 25096 - DNA, 23 bp, Artificial Sequence
  Synthetic Construct
ccctccccatctcctcttcttac

SEQ ID NO: 25097 - DNA, 21 bp, Artificial Sequence
  Synthetic Construct
aaggccggatggtggagattg

SEQ ID NO: 25098 - DNA, 19 bp, Artificial Sequence
  Synthetic Construct
cacacgtgcatgggtgttc

SEQ ID NO: 25099 - DNA, 23 bp, Artificial Sequence
  Synthetic Construct
ggggtcagaaagctgagagtcta

SEQ ID NO: 25100 - DNA, 26 bp, Artificial Sequence
  Synthetic Construct
gggttctacagtttccaccattaaac

SEQ ID NO: 25101 - DNA, 22 bp, Artificial Sequence
  Synthetic Construct
ccagccaggattactgctgttc

SEQ ID NO: 25102 - DNA, 24 bp, Artificial Sequence
  Synthetic Construct
gagcaactggcagagtatgacaag

SEQ ID NO: 25103 - DNA, 20 bp, Artificial Sequence
  Synthetic Construct
ggcaaggggcttgctctgat

SEQ ID NO: 25104 - DNA, 20 bp, Artificial Sequence
  Synthetic Construct
agcagcagcccacgggaaga

SEQ ID NO: 25105 - DNA, 24 bp, Artificial Sequence
  Synthetic Construct
ctctgcagtctccacatcaggttt

SEQ ID NO: 25106 - DNA, 26 bp, Artificial Sequence
  Synthetic Construct
ccctatcttgcagctctcattccatt

SEQ ID NO: 25107 - DNA, 21 bp, Artificial Sequence
  Synthetic Construct
actttggccccatttctccaa

SEQ ID NO: 25108 - DNA, 19 bp, Artificial Sequence
  Synthetic Construct
agggtgctgcttgggttgt

SEQ ID NO: 25109 - DNA, 25 bp, Artificial Sequence
  Synthetic Construct
cagtatcatgcggtcacctagtctt

SEQ ID NO: 25110 - DNA, 22 bp, Artificial Sequence
  Synthetic Construct
tcaagctgtctggggaggtttc

SEQ ID NO: 25111 - DNA, 25 bp, Artificial Sequence
  Synthetic Construct
agacagggaagttgtgggtatatga

SEQ ID NO: 25112 - DNA, 20 bp, Artificial Sequence
  Synthetic Construct
tggccgccttacaccaaaac

SEQ ID NO: 25113 - DNA, 19 bp, Artificial Sequence
  Synthetic Construct
caggcccggaaccctttct

SEQ ID NO: 25114 - DNA, 21 bp, Artificial Sequence
  Synthetic Construct
actgtcacacgcttcctgaat

SEQ ID NO: 25115 - DNA, 20 bp, Artificial Sequence
  Synthetic Construct
cctggccgctgttacagact

SEQ ID NO: 25116 - DNA, 23 bp, Artificial Sequence
  Synthetic Construct
cctaggagtgtccagctctgttc

SEQ ID NO: 25117 - DNA, 20 bp, Artificial Sequence
  Synthetic Construct
tgactcgctgtgtcctgtga

SEQ ID NO: 25118 - DNA, 22 bp, Artificial Sequence
  Synthetic Construct
aggccacagtgttgctctgttc

SEQ ID NO: 25119 - DNA, 20 bp, Artificial Sequence
  Synthetic Construct
ttgctctgaggccctacact

SEQ ID NO: 25120 - DNA, 24 bp, Artificial Sequence
  Synthetic Construct
gtacctggctgggatatgtgtttt

SEQ ID NO: 25121 - DNA, 21 bp, Artificial Sequence
  Synthetic Construct
aggagaacccatcctgcatct

SEQ ID NO: 25122 - DNA, 26 bp, Artificial Sequence
  Synthetic Construct
ggctactggggaatttaatacagtct

SEQ ID NO: 25123 - DNA, 22 bp, Artificial Sequence
  Synthetic Construct
ccttcagcagtgcctgacaaac

SEQ ID NO: 25124 - DNA, 23 bp, Artificial Sequence
  Synthetic Construct
ccaaagcataggctgttgtgagt

SEQ ID NO: 25125 - DNA, 24 bp, Artificial Sequence
  Synthetic Construct
gtccaggacgtgctcctagtatct

SEQ ID NO: 25126 - DNA, 22 bp, Artificial Sequence
  Synthetic Construct
cagggccagtgttcttccaaac

SEQ ID NO: 25127 - DNA, 23 bp, Artificial Sequence
  Synthetic Construct
ggttactgttggggctcaggaaa

SEQ ID NO: 25128 - DNA, 20 bp, Artificial Sequence
  Synthetic Construct
gtgccttccgagagctgtga

SEQ ID NO: 25129 - DNA, 22 bp, Artificial Sequence
  Synthetic Construct
ttgaacacctctgctcaacaca

SEQ ID NO: 25130 - DNA, 20 bp, Artificial Sequence
  Synthetic Construct
accaggcccaccccagtaaa

SEQ ID NO: 25131 - DNA, 21 bp, Artificial Sequence
  Synthetic Construct
cagcccataccctccctgcta

SEQ ID NO: 25132 - DNA, 22 bp, Artificial Sequence
  Synthetic Construct
gcctgtggtaccctgggaaaga

SEQ ID NO: 25133 - DNA, 22 bp, Artificial Sequence
  Synthetic Construct
gggtgccaggtacagaacaagt

SEQ ID NO: 25134 - DNA, 25 bp, Artificial Sequence
  Synthetic Construct
ctgtggaatttctccctggggtatg

SEQ ID NO: 25135 - DNA, 22 bp, Artificial Sequence
  Synthetic Construct
acctcaggctaatgtccacttg

SEQ ID NO: 25136 - DNA, 22 bp, Artificial Sequence
  Synthetic Construct
gtggatcaggataggggctcaa

SEQ ID NO: 25137 - DNA, 24 bp, Artificial Sequence
  Synthetic Construct
ggtctatccgggtctatccagcat

SEQ ID NO: 25138 - DNA, 20 bp, Artificial Sequence
  Synthetic Construct
tctgccctctgtgcttcagt

SEQ ID NO: 25139 - DNA, 22 bp, Artificial Sequence
  Synthetic Construct
ggtttgccctctgcctgtttct

SEQ ID NO: 25140 - DNA, 19 bp, Artificial Sequence
  Synthetic Construct
ttccgcccatgcccctaca

SEQ ID NO: 25141 - DNA, 26 bp, Artificial Sequence
  Synthetic Construct
gacgtcaccatgttttcctgtagttg

SEQ ID NO: 25142 - DNA, 24 bp, Artificial Sequence
  Synthetic Construct
ctcccaatgaatcctcctccttca

SEQ ID NO: 25143 - DNA, 22 bp, Artificial Sequence
  Synthetic Construct
aggtagggttcttccccagttc

SEQ ID NO: 25144 - DNA, 22 bp, Artificial Sequence
  Synthetic Construct
ggctttcctcactgtggtgttc

SEQ ID NO: 25145 - DNA, 24 bp, Artificial Sequence
  Synthetic Construct
cctcaaccccttcatctacagctt

SEQ ID NO: 25146 - DNA, 22 bp, Artificial Sequence
  Synthetic Construct
tcggtctctgcctgtagactgt

SEQ ID NO: 25147 - DNA, 20 bp, Artificial Sequence
  Synthetic Construct
ggccggtggaggtttttgat

SEQ ID NO: 25148 - DNA, 22 bp, Artificial Sequence
  Synthetic Construct
caggcctagcagtggtaaatca

SEQ ID NO: 25149 - DNA, 22 bp, Artificial Sequence
  Synthetic Construct
ccatgcctggccctttgaaaca

SEQ ID NO: 25150 - DNA, 22 bp, Artificial Sequence
  Synthetic Construct
cccagggccatctgtgatacaa

SEQ ID NO: 25151 - DNA, 19 bp, Artificial Sequence
  Synthetic Construct
tcgcctgcctctcctcaca

SEQ ID NO: 25152 - DNA, 21 bp, Artificial Sequence
  Synthetic Construct
tgggaggatggcgctttggat

SEQ ID NO: 25153 - DNA, 20 bp, Artificial Sequence
  Synthetic Construct
tgggcccaccagtcacttct

SEQ ID NO: 25154 - DNA, 21 bp, Artificial Sequence
  Synthetic Construct
tggttagtgcacaagcagtgt

SEQ ID NO: 25155 - DNA, 20 bp, Artificial Sequence
  Synthetic Construct
gcaaatctgggcgactctga

SEQ ID NO: 25156 - DNA, 20 bp, Artificial Sequence
  Synthetic Construct
gcctccagctcccagactca

SEQ ID NO: 25157 - DNA, 22 bp, Artificial Sequence
  Synthetic Construct
tctaaggccacggggataggaa

SEQ ID NO: 25158 - DNA, 23 bp, Artificial Sequence
  Synthetic Construct
tgaaacaaggtgacaaggtgact

SEQ ID NO: 25159 - DNA, 25 bp, Artificial Sequence
  Synthetic Construct
ccaggacatgatcaaaactggattg

SEQ ID NO: 25160 - DNA, 21 bp, Artificial Sequence
  Synthetic Construct
ggagcttggcaggaggtgtaa

SEQ ID NO: 25161 - DNA, 21 bp, Artificial Sequence
  Synthetic Construct
gagcctgaggagccattttga

SEQ ID NO: 25162 - DNA, 20 bp, Artificial Sequence
  Synthetic Construct
tccgtcggagggtgcttttt

SEQ ID NO: 25163 - DNA, 22 bp, Artificial Sequence
  Synthetic Construct
gggagctgtccatagaggcaat

SEQ ID NO: 25164 - DNA, 21 bp, Artificial Sequence
  Synthetic Construct
tggatgcctcttgccagaaaa

SEQ ID NO: 25165 - DNA, 21 bp, Artificial Sequence
  Synthetic Construct
gaagatggagccttggcatgt

SEQ ID NO: 25166 - DNA, 20 bp, Artificial Sequence
  Synthetic Construct
gcaaagggccagagagtcaa

SEQ ID NO: 25167 - DNA, 22 bp, Artificial Sequence
  Synthetic Construct
ggcaggatggatttgggccatt

SEQ ID NO: 25168 - DNA, 24 bp, Artificial Sequence
  Synthetic Construct
ggtcctcatgagcttcaggttatt

SEQ ID NO: 25169 - DNA, 19 bp, Artificial Sequence
  Synthetic Construct
gtcggccagcccttcagat

SEQ ID NO: 25170 - DNA, 23 bp, Artificial Sequence
  Synthetic Construct
gggctacgaaggacatttagcat

SEQ ID NO: 25171 - DNA, 20 bp, Artificial Sequence
  Synthetic Construct
ctgtttgggtctgcgtcagt

SEQ ID NO: 25172 - DNA, 26 bp, Artificial Sequence
  Synthetic Construct
gggccattataacaggaacgggaaac

SEQ ID NO: 25173 - DNA, 20 bp, Artificial Sequence
  Synthetic Construct
agaatctggcagcccctaca

SEQ ID NO: 25174 - DNA, 22 bp, Artificial Sequence
  Synthetic Construct
tccagcccagctgtcactaact

SEQ ID NO: 25175 - DNA, 23 bp, Artificial Sequence
  Synthetic Construct
ctgaagtctgcacctgagtgagt

SEQ ID NO: 25176 - DNA, 21 bp, Artificial Sequence
  Synthetic Construct
agagggaccacaccctggaat

SEQ ID NO: 25177 - DNA, 22 bp, Artificial Sequence
  Synthetic Construct
accctgccaggacacatgagat

SEQ ID NO: 25178 - DNA, 24 bp, Artificial Sequence
  Synthetic Construct
gccacagagctgaaggctaggata

SEQ ID NO: 25179 - DNA, 21 bp, Artificial Sequence
  Synthetic Construct
gctgccccatgctgaagagat

SEQ ID NO: 25180 - DNA, 25 bp, Artificial Sequence
  Synthetic Construct
ggtttggaccctgctcatatcttga

SEQ ID NO: 25181 - DNA, 20 bp, Artificial Sequence
  Synthetic Construct
aaacggcccagggtggattc

SEQ ID NO: 25182 - DNA, 23 bp, Artificial Sequence
  Synthetic Construct
gccagtccatctgttcaggcttt

SEQ ID NO: 25183 - DNA, 21 bp, Artificial Sequence
  Synthetic Construct
caggcttagccccaattgact

SEQ ID NO: 25184 - DNA, 22 bp, Artificial Sequence
  Synthetic Construct
gtgtctggcccaaggttataca

SEQ ID NO: 25185 - DNA, 25 bp, Artificial Sequence
  Synthetic Construct
ccctaagtggaatcctgagtgaaat

SEQ ID NO: 25186 - DNA, 22 bp, Artificial Sequence
  Synthetic Construct
gagccggaagaactcaggatgt

SEQ ID NO: 25187 - DNA, 22 bp, Artificial Sequence
  Synthetic Construct
gggatttgcccaggagtgtctt

SEQ ID NO: 25188 - DNA, 21 bp, Artificial Sequence
  Synthetic Construct
cagcccttggggtgtagcttt

SEQ ID NO: 25189 - DNA, 20 bp, Artificial Sequence
  Synthetic Construct
gctgggtgtggctatgtgtt

SEQ ID NO: 25190 - DNA, 22 bp, Artificial Sequence
  Synthetic Construct
gcctgcaccctaaggacacttt

SEQ ID NO: 25191 - DNA, 22 bp, Artificial Sequence
  Synthetic Construct
gggtgtcacctccatctacaca

SEQ ID NO: 25192 - DNA, 24 bp, Artificial Sequence
  Synthetic Construct
ccaaggccgtccttcaatactttg

SEQ ID NO: 25193 - DNA, 25 bp, Artificial Sequence
  Synthetic Construct
ggggaaagaaaagctggaaaacaac

SEQ ID NO: 25194 - DNA, 20 bp, Artificial Sequence
  Synthetic Construct
actaggccctgctgctagat

SEQ ID NO: 25195 - DNA, 22 bp, Artificial Sequence
  Synthetic Construct
ggcaggcaggaaataggaggtt

SEQ ID NO: 25196 - DNA, 24 bp, Artificial Sequence
  Synthetic Construct
aatcttcctggggttcattctgtt

SEQ ID NO: 25197 - DNA, 26 bp, Artificial Sequence
  Synthetic Construct
gtgtcacagggtatggaagtcacaac

SEQ ID NO: 25198 - DNA, 20 bp, Artificial Sequence
  Synthetic Construct
tgaccctggagggagccttt

SEQ ID NO: 25199 - DNA, 22 bp, Artificial Sequence
  Synthetic Construct
gaggacagcagatcctccgtaa

SEQ ID NO: 25200 - DNA, 25 bp, Artificial Sequence
  Synthetic Construct
catttccaagggcagtagaaagtct

SEQ ID NO: 25201 - DNA, 25 bp, Artificial Sequence
  Synthetic Construct
agtgggagtccagatgatagagatt

SEQ ID NO: 25202 - DNA, 21 bp, Artificial Sequence
  Synthetic Construct
caacagcgagggaccatgtct

SEQ ID NO: 25203 - DNA, 21 bp, Artificial Sequence
  Synthetic Construct
ccacctccccacttcccgata

SEQ ID NO: 25204 - DNA, 22 bp, Artificial Sequence
  Synthetic Construct
gcaacttggggtaggtggtgaa

SEQ ID NO: 25205 - DNA, 21 bp, Artificial Sequence
  Synthetic Construct
cgcagcccatgccaatctttc

SEQ ID NO: 25206 - DNA, 22 bp, Artificial Sequence
  Synthetic Construct
cgagactgaggcccactgtttt

SEQ ID NO: 25207 - DNA, 22 bp, Artificial Sequence
  Synthetic Construct
tggcaaagcctgacctggaatc

SEQ ID NO: 25208 - DNA, 23 bp, Artificial Sequence
  Synthetic Construct
gaccgggattgaaacctccacaa

SEQ ID NO: 25209 - DNA, 26 bp, Artificial Sequence
  Synthetic Construct
catttctcccaggaaagaggaagaac

SEQ ID NO: 25210 - DNA, 20 bp, Artificial Sequence
  Synthetic Construct
tggctgcgccatcgaaaaca

SEQ ID NO: 25211 - DNA, 21 bp, Artificial Sequence
  Synthetic Construct
tgtcccgcttgccttcctaga

SEQ ID NO: 25212 - DNA, 18 bp, Artificial Sequence
  Synthetic Construct
tcccggcttcctggagtt

SEQ ID NO: 25213 - DNA, 22 bp, Artificial Sequence
  Synthetic Construct
gctgttccctgcacttggaatc

SEQ ID NO: 25214 - DNA, 22 bp, Artificial Sequence
  Synthetic Construct
aaggcaaggggtgaggaagttg

SEQ ID NO: 25215 - DNA, 18 bp, Artificial Sequence
  Synthetic Construct
acagcagacggcgagaag

SEQ ID NO: 25216 - DNA, 26 bp, Artificial Sequence
  Synthetic Construct
ccgaaacactaagggaggaagtgtat

SEQ ID NO: 25217 - DNA, 24 bp, Artificial Sequence
  Synthetic Construct
tggatccttgaaagctctctgact

SEQ ID NO: 25218 - DNA, 23 bp, Artificial Sequence
  Synthetic Construct
gaggtgatctgagcttgggcata

SEQ ID NO: 25219 - DNA, 20 bp, Artificial Sequence
  Synthetic Construct
cagcgggcctgttacagagt

SEQ ID NO: 25220 - DNA, 23 bp, Artificial Sequence
  Synthetic Construct
ggggacaatcactggagggttct

SEQ ID NO: 25221 - DNA, 22 bp, Artificial Sequence
  Synthetic Construct
tctggggtgtggaccctaggaa

SEQ ID NO: 25222 - DNA, 20 bp, Artificial Sequence
  Synthetic Construct
tcccaccagctcttcgtgat

SEQ ID NO: 25223 - DNA, 22 bp, Artificial Sequence
  Synthetic Construct
tgtcctttcccctgctctttac

SEQ ID NO: 25224 - DNA, 23 bp, Artificial Sequence
  Synthetic Construct
ccaggctcctattgctcctattg

SEQ ID NO: 25225 - DNA, 23 bp, Artificial Sequence
  Synthetic Construct
gaagctctgacctccatttcagt

SEQ ID NO: 25226 - DNA, 22 bp, Artificial Sequence
  Synthetic Construct
actggtacagccctgatgaaca

SEQ ID NO: 25227 - DNA, 21 bp, Artificial Sequence
  Synthetic Construct
accacccctccatgcttgtct

SEQ ID NO: 25228 - DNA, 21 bp, Artificial Sequence
  Synthetic Construct
gcagccagatttcaggtccaa

SEQ ID NO: 25229 - DNA, 22 bp, Artificial Sequence
  Synthetic Construct
ggccccagcctcaaagaatgta

SEQ ID NO: 25230 - DNA, 18 bp, Artificial Sequence
  Synthetic Construct
tgagcctcgggcagctaa

SEQ ID NO: 25231 - DNA, 23 bp, Artificial Sequence
  Synthetic Construct
gtgcgcctgacaaggaaatgact

SEQ ID NO: 25232 - DNA, 20 bp, Artificial Sequence
  Synthetic Construct
cccgctgtcagccaagtgta

SEQ ID NO: 25233 - DNA, 23 bp, Artificial Sequence
  Synthetic Construct
caggctcagaggacctatgtttg

SEQ ID NO: 25234 - DNA, 20 bp, Artificial Sequence
  Synthetic Construct
gcctgcagccctcatacagt

SEQ ID NO: 25235 - DNA, 22 bp, Artificial Sequence
  Synthetic Construct
ccaagtggccagggaaaaccta

SEQ ID NO: 25236 - DNA, 21 bp, Artificial Sequence
  Synthetic Construct
tgagccactgagcctagtgaa

SEQ ID NO: 25237 - DNA, 24 bp, Artificial Sequence
  Synthetic Construct
ggcctcagcctctaactgaggata

SEQ ID NO: 25238 - DNA, 21 bp, Artificial Sequence
  Synthetic Construct
ccccgataggctgaaaacaca

SEQ ID NO: 25239 - DNA, 23 bp, Artificial Sequence
  Synthetic Construct
gctgacatgtggagtcaaccatt

SEQ ID NO: 25240 - DNA, 20 bp, Artificial Sequence
  Synthetic Construct
ggcacacgacccacctatct

SEQ ID NO: 25241 - DNA, 23 bp, Artificial Sequence
  Synthetic Construct
ggaagggcatagagagaccatct

SEQ ID NO: 25242 - DNA, 24 bp, Artificial Sequence
  Synthetic Construct
actaatggtgacattggtggaaca

SEQ ID NO: 25243 - DNA, 21 bp, Artificial Sequence
  Synthetic Construct
gtgccacaccatcctcaccta

SEQ ID NO: 25244 - DNA, 20 bp, Artificial Sequence
  Synthetic Construct
ggccagtcccttcaatgtca

SEQ ID NO: 25245 - DNA, 21 bp, Artificial Sequence
  Synthetic Construct
ttccctgcccttccacctttc

SEQ ID NO: 25246 - DNA, 24 bp, Artificial Sequence
  Synthetic Construct
agaattcaaccaccattggcagat

SEQ ID NO: 25247 - DNA, 21 bp, Artificial Sequence
  Synthetic Construct
gctggtccctggaaggggata

SEQ ID NO: 25248 - DNA, 22 bp, Artificial Sequence
  Synthetic Construct
ccatccctgcaggagaggagat

SEQ ID NO: 25249 - DNA, 20 bp, Artificial Sequence
  Synthetic Construct
ttccctccccaaagccacaa

SEQ ID NO: 25250 - DNA, 22 bp, Artificial Sequence
  Synthetic Construct
ctcctcagcaggaggagtttgt

SEQ ID NO: 25251 - DNA, 19 bp, Artificial Sequence
  Synthetic Construct
agcacagggctcacagcta

SEQ ID NO: 25252 - DNA, 20 bp, Artificial Sequence
  Synthetic Construct
gctgcctgagaacgtcttga

SEQ ID NO: 25253 - DNA, 22 bp, Artificial Sequence
  Synthetic Construct
cgaaagagcacagccaaacaca

SEQ ID NO: 25254 - DNA, 22 bp, Artificial Sequence
  Synthetic Construct
acagagctcctggaggcaagat

SEQ ID NO: 25255 - DNA, 20 bp, Artificial Sequence
  Synthetic Construct
ggctgctcagcttgcctgta

SEQ ID NO: 25256 - DNA, 19 bp, Artificial Sequence
  Synthetic Construct
ccccggtggagacaaggaa

SEQ ID NO: 25257 - DNA, 20 bp, Artificial Sequence
  Synthetic Construct
cactgccagggtggtcaatc

SEQ ID NO: 25258 - DNA, 20 bp, Artificial Sequence
  Synthetic Construct
tggagaccgttctcggctat

SEQ ID NO: 25259 - DNA, 23 bp, Artificial Sequence
  Synthetic Construct
gggctagggagtgtttctcaaag

SEQ ID NO: 25260 - DNA, 22 bp, Artificial Sequence
  Synthetic Construct
gatgctaccctgaggcttgaaa

SEQ ID NO: 25261 - DNA, 21 bp, Artificial Sequence
  Synthetic Construct
ccagccagcaagcatcctgaa

SEQ ID NO: 25262 - DNA, 24 bp, Artificial Sequence
  Synthetic Construct
ggggtgacttgtaaaccatcttgt

SEQ ID NO: 25263 - DNA, 24 bp, Artificial Sequence
  Synthetic Construct
aaaactggctacgcactttgtaag

SEQ ID NO: 25264 - DNA, 19 bp, Artificial Sequence
  Synthetic Construct
ccctgccatgagcccttca

SEQ ID NO: 25265 - DNA, 20 bp, Artificial Sequence
  Synthetic Construct
gcccctctgctcttctcaca

SEQ ID NO: 25266 - DNA, 23 bp, Artificial Sequence
  Synthetic Construct
caatcctagcatagggtgcttca

SEQ ID NO: 25267 - DNA, 20 bp, Artificial Sequence
  Synthetic Construct
cgtgtcgctgccagacagat

SEQ ID NO: 25268 - DNA, 25 bp, Artificial Sequence
  Synthetic Construct
gcttaaacctcagctccaccactta

SEQ ID NO: 25269 - DNA, 20 bp, Artificial Sequence
  Synthetic Construct
tgtggccctctctctccaat

SEQ ID NO: 25270 - DNA, 22 bp, Artificial Sequence
  Synthetic Construct
tgaactgctgtccagggtcgat

SEQ ID NO: 25271 - DNA, 18 bp, Artificial Sequence
  Synthetic Construct
gcatcgcgtcgagaggaa

SEQ ID NO: 25272 - DNA, 20 bp, Artificial Sequence
  Synthetic Construct
tctgcccaccatctgactgt

SEQ ID NO: 25273 - DNA, 22 bp, Artificial Sequence
  Synthetic Construct
atgctaattgctgggccctatt

SEQ ID NO: 25274 - DNA, 26 bp, Artificial Sequence
  Synthetic Construct
cctggaacacaaaaccagaagtcaga

SEQ ID NO: 25275 - DNA, 18 bp, Artificial Sequence
  Synthetic Construct
tcccaggctcccacactt

SEQ ID NO: 25276 - DNA, 22 bp, Artificial Sequence
  Synthetic Construct
tctccacacctttgccagaatg

SEQ ID NO: 25277 - DNA, 19 bp, Artificial Sequence
  Synthetic Construct
tgagcctcgctgcaccttt

SEQ ID NO: 25278 - DNA, 22 bp, Artificial Sequence
  Synthetic Construct
tgggctcctcccctgaaaatac

SEQ ID NO: 25279 - DNA, 23 bp, Artificial Sequence
  Synthetic Construct
gcaacatggctggtacacatttc

SEQ ID NO: 25280 - DNA, 22 bp, Artificial Sequence
  Synthetic Construct
gcagggtttgccttctgctcta

SEQ ID NO: 25281 - DNA, 21 bp, Artificial Sequence
  Synthetic Construct
ggaaacaggcccaaggtgcat

SEQ ID NO: 25282 - DNA, 24 bp, Artificial Sequence
  Synthetic Construct
tgctagacaacctgggtagtaaca

SEQ ID NO: 25283 - DNA, 22 bp, Artificial Sequence
  Synthetic Construct
tgctcctcctccgaggtaaaga

SEQ ID NO: 25284 - DNA, 20 bp, Artificial Sequence
  Synthetic Construct
cacaggcaacctctgctcat

SEQ ID NO: 25285 - DNA, 20 bp, Artificial Sequence
  Synthetic Construct
cacggacgcgcatgaaagaa

SEQ ID NO: 25286 - DNA, 19 bp, Artificial Sequence
  Synthetic Construct
tgtgtcctcggcggtgtgt

SEQ ID NO: 25287 - DNA, 20 bp, Artificial Sequence
  Synthetic Construct
gggagatctgggctcacgtt

SEQ ID NO: 25288 - DNA, 22 bp, Artificial Sequence
  Synthetic Construct
gacctccaacttgtggcagaca

SEQ ID NO: 25289 - DNA, 23 bp, Artificial Sequence
  Synthetic Construct
gggcacaaaacctctggatgcaa

SEQ ID NO: 25290 - DNA, 18 bp, Artificial Sequence
  Synthetic Construct
agccgtggctgtccacat

SEQ ID NO: 25291 - DNA, 21 bp, Artificial Sequence
  Synthetic Construct
tcctggttcctcccactgcat

SEQ ID NO: 25292 - DNA, 21 bp, Artificial Sequence
  Synthetic Construct
cagttttgtggggctctgtct

SEQ ID NO: 25293 - DNA, 24 bp, Artificial Sequence
  Synthetic Construct
gccatccatctcctctttcctaca

SEQ ID NO: 25294 - DNA, 22 bp, Artificial Sequence
  Synthetic Construct
tgggcacctcaaacttaacaca

SEQ ID NO: 25295 - DNA, 20 bp, Artificial Sequence
  Synthetic Construct
ttgggccaactcccactctt

SEQ ID NO: 25296 - DNA, 25 bp, Artificial Sequence
  Synthetic Construct
tcctgtatccctgacttgactagaa

SEQ ID NO: 25297 - DNA, 24 bp, Artificial Sequence
  Synthetic Construct
gagatatggacgggaagcagaaac

SEQ ID NO: 25298 - DNA, 25 bp, Artificial Sequence
  Synthetic Construct
tcgactcataaatggctgtgaaaca

SEQ ID NO: 25299 - DNA, 23 bp, Artificial Sequence
  Synthetic Construct
gggcttcatttgccatactgaga

SEQ ID NO: 25300 - DNA, 23 bp, Artificial Sequence
  Synthetic Construct
aggccacaaaatgcttcaagttc

SEQ ID NO: 25301 - DNA, 24 bp, Artificial Sequence
  Synthetic Construct
ggacatggagcaggtagttagcaa

SEQ ID NO: 25302 - DNA, 19 bp, Artificial Sequence
  Synthetic Construct
gcagccagacccactctga

SEQ ID NO: 25303 - DNA, 26 bp, Artificial Sequence
  Synthetic Construct
cccaatgttttagtctgaacctgaag

SEQ ID NO: 25304 - DNA, 21 bp, Artificial Sequence
  Synthetic Construct
gtggaagccactgcctgtttg

SEQ ID NO: 25305 - DNA, 20 bp, Artificial Sequence
  Synthetic Construct
aggcccacgctgtcttccta

SEQ ID NO: 25306 - DNA, 20 bp, Artificial Sequence
  Synthetic Construct
cccggccctaagagtcacat

SEQ ID NO: 25307 - DNA, 24 bp, Artificial Sequence
  Synthetic Construct
gtgtattttggcaatggcatcctt

SEQ ID NO: 25308 - DNA, 21 bp, Artificial Sequence
  Synthetic Construct
gagcccttcgtgttgatgaga

SEQ ID NO: 25309 - DNA, 24 bp, Artificial Sequence
  Synthetic Construct
gcagcaccggcaaactaatacaat

SEQ ID NO: 25310 - DNA, 22 bp, Artificial Sequence
  Synthetic Construct
ccccttgcctagagtcatcaga

SEQ ID NO: 25311 - DNA, 21 bp, Artificial Sequence
  Synthetic Construct
gctgcctgccatgaccttgat

SEQ ID NO: 25312 - DNA, 23 bp, Artificial Sequence
  Synthetic Construct
acctgggtttaggctgatgagat

SEQ ID NO: 25313 - DNA, 22 bp, Artificial Sequence
  Synthetic Construct
ctggcctagggtcttagtggtt

SEQ ID NO: 25314 - DNA, 22 bp, Artificial Sequence
  Synthetic Construct
ggacttccccaccagcgttttt

SEQ ID NO: 25315 - DNA, 25 bp, Artificial Sequence
  Synthetic Construct
tcttccatggagctctttccaaatc

SEQ ID NO: 25316 - DNA, 24 bp, Artificial Sequence
  Synthetic Construct
gaaacaggttccagtgggtaaaga

SEQ ID NO: 25317 - DNA, 25 bp, Artificial Sequence
  Synthetic Construct
caagcaaggcttgggatcaataaag

SEQ ID NO: 25318 - DNA, 21 bp, Artificial Sequence
  Synthetic Construct
actggaaaagcaccaccacat

SEQ ID NO: 25319 - DNA, 22 bp, Artificial Sequence
  Synthetic Construct
gctcaccatccatgaggaaaca

SEQ ID NO: 25320 - DNA, 26 bp, Artificial Sequence
  Synthetic Construct
ctccatggggataaaacagtggtaac

SEQ ID NO: 25321 - DNA, 22 bp, Artificial Sequence
  Synthetic Construct
cgaggcccagttccaagaaaga

SEQ ID NO: 25322 - DNA, 24 bp, Artificial Sequence
  Synthetic Construct
gcagctggggaggaaaaagtgtag

SEQ ID NO: 25323 - DNA, 24 bp, Artificial Sequence
  Synthetic Construct
ccatggctcaactctttccacgaa

SEQ ID NO: 25324 - DNA, 23 bp, Artificial Sequence
  Synthetic Construct
ggcatcacctgattgctgatagt

SEQ ID NO: 25325 - DNA, 22 bp, Artificial Sequence
  Synthetic Construct
cttccagcttcctgttctcctt

SEQ ID NO: 25326 - DNA, 21 bp, Artificial Sequence
  Synthetic Construct
aagagggcaggtcagggattg

SEQ ID NO: 25327 - DNA, 25 bp, Artificial Sequence
  Synthetic Construct
gctggatgagggaacacctgatttt

SEQ ID NO: 25328 - DNA, 23 bp, Artificial Sequence
  Synthetic Construct
gagggagagttagggaggccata

SEQ ID NO: 25329 - DNA, 20 bp, Artificial Sequence
  Synthetic Construct
tgctgtccagctctcctgtt

SEQ ID NO: 25330 - DNA, 21 bp, Artificial Sequence
  Synthetic Construct
atggacccacggggacctaat

SEQ ID NO: 25331 - DNA, 23 bp, Artificial Sequence
  Synthetic Construct
ttgtgccctagaggatgtctact

SEQ ID NO: 25332 - DNA, 23 bp, Artificial Sequence
  Synthetic Construct
tgtttttgtccccactgacatct

SEQ ID NO: 25333 - DNA, 24 bp, Artificial Sequence
  Synthetic Construct
ccacagggacccctatcacttatg

SEQ ID NO: 25334 - DNA, 19 bp, Artificial Sequence
  Synthetic Construct
aggttgcaggcgggattga

SEQ ID NO: 25335 - DNA, 22 bp, Artificial Sequence
  Synthetic Construct
ggcagagggagtgccataaaca

SEQ ID NO: 25336 - DNA, 20 bp, Artificial Sequence
  Synthetic Construct
gcctgccatccctgtacact

SEQ ID NO: 25337 - DNA, 21 bp, Artificial Sequence
  Synthetic Construct
gtgggagcaggtagagtgaga

SEQ ID NO: 25338 - DNA, 24 bp, Artificial Sequence
  Synthetic Construct
gtctatatggtcttggcagctgaa

SEQ ID NO: 25339 - DNA, 19 bp, Artificial Sequence
  Synthetic Construct
gtgagcagtggcggtgact

SEQ ID NO: 25340 - DNA, 27 bp, Artificial Sequence
  Synthetic Construct
ctgtggataaagccaatggatactgtt

SEQ ID NO: 25341 - DNA, 22 bp, Artificial Sequence
  Synthetic Construct
ggctgtcagtgttcagttgtgt

SEQ ID NO: 25342 - DNA, 20 bp, Artificial Sequence
  Synthetic Construct
tttgggctggagacctcgtt

SEQ ID NO: 25343 - DNA, 24 bp, Artificial Sequence
  Synthetic Construct
aacctacctcctgctggtatatct

SEQ ID NO: 25344 - DNA, 20 bp, Artificial Sequence
  Synthetic Construct
cgaggctcgagctgttgtga

SEQ ID NO: 25345 - DNA, 21 bp, Artificial Sequence
  Synthetic Construct
ccccgtgactcattggctcat

SEQ ID NO: 25346 - DNA, 24 bp, Artificial Sequence
  Synthetic Construct
gacatgtggtgtagacacgaggta

SEQ ID NO: 25347 - DNA, 21 bp, Artificial Sequence
  Synthetic Construct
aggagagcaggcacacccata

SEQ ID NO: 25348 - DNA, 25 bp, Artificial Sequence
  Synthetic Construct
ctgcctcagtgaatccagactgatg

SEQ ID NO: 25349 - DNA, 20 bp, Artificial Sequence
  Synthetic Construct
actgtgtgccacagcaaact

SEQ ID NO: 25350 - DNA, 21 bp, Artificial Sequence
  Synthetic Construct
agtcccttcctgggagtcaaa

SEQ ID NO: 25351 - DNA, 23 bp, Artificial Sequence
  Synthetic Construct
ctcaagtcccttcaaccttcctt

SEQ ID NO: 25352 - DNA, 24 bp, Artificial Sequence
  Synthetic Construct
ggacctagaacctgtgtcccttgt

SEQ ID NO: 25353 - DNA, 20 bp, Artificial Sequence
  Synthetic Construct
gggaatggctcgctcacgtt

SEQ ID NO: 25354 - DNA, 22 bp, Artificial Sequence
  Synthetic Construct
gggacatggcagagctgaacta

SEQ ID NO: 25355 - DNA, 24 bp, Artificial Sequence
  Synthetic Construct
ttggagaccaccaaagaatcaaga

SEQ ID NO: 25356 - DNA, 25 bp, Artificial Sequence
  Synthetic Construct
catgaagaaagacgggtatctggaa

SEQ ID NO: 25357 - DNA, 25 bp, Artificial Sequence
  Synthetic Construct
gcttgaatcttgcattcatctgctt

SEQ ID NO: 25358 - DNA, 18 bp, Artificial Sequence
  Synthetic Construct
cgccaccgagtgctttct

SEQ ID NO: 25359 - DNA, 21 bp, Artificial Sequence
  Synthetic Construct
ggctagcaaagctcccacaca

SEQ ID NO: 25360 - DNA, 23 bp, Artificial Sequence
  Synthetic Construct
gctggagatactacagcaagcaa

SEQ ID NO: 25361 - DNA, 22 bp, Artificial Sequence
  Synthetic Construct
ctgctgctccccaatcctaact

SEQ ID NO: 25362 - DNA, 23 bp, Artificial Sequence
  Synthetic Construct
ggaactgggcctcattcaccatt

SEQ ID NO: 25363 - DNA, 22 bp, Artificial Sequence
  Synthetic Construct
tgacaaccaccacgctattaca

SEQ ID NO: 25364 - DNA, 19 bp, Artificial Sequence
  Synthetic Construct
atgcgccacagtgggtaca

SEQ ID NO: 25365 - DNA, 21 bp, Artificial Sequence
  Synthetic Construct
cccctttgccacatcttggtt

SEQ ID NO: 25366 - DNA, 22 bp, Artificial Sequence
  Synthetic Construct
ccctgtcatccatgggagctta

SEQ ID NO: 25367 - DNA, 24 bp, Artificial Sequence
  Synthetic Construct
caagagcatgaagcaaagtgacat

SEQ ID NO: 25368 - DNA, 22 bp, Artificial Sequence
  Synthetic Construct
ccccagaactcagagtcagctt

SEQ ID NO: 25369 - DNA, 24 bp, Artificial Sequence
  Synthetic Construct
gctttcttgggaaccagagcagtt

SEQ ID NO: 25370 - DNA, 19 bp, Artificial Sequence
  Synthetic Construct
aacagcagctgcgctccat

SEQ ID NO: 25371 - DNA, 24 bp, Artificial Sequence
  Synthetic Construct
ggggcacaaaggaggagacaatta

SEQ ID NO: 25372 - DNA, 25 bp, Artificial Sequence
  Synthetic Construct
aggaagaccctgtctctacaaaatc

SEQ ID NO: 25373 - DNA, 21 bp, Artificial Sequence
  Synthetic Construct
cgtttcccacctgtcgagtct

SEQ ID NO: 25374 - DNA, 24 bp, Artificial Sequence
  Synthetic Construct
tgggaaggaatggcatctaactct

SEQ ID NO: 25375 - DNA, 26 bp, Artificial Sequence
  Synthetic Construct
cccaatcagacgtgaagttttcttgt

SEQ ID NO: 25376 - DNA, 22 bp, Artificial Sequence
  Synthetic Construct
ccttctcaggtgcaggaaaagt

SEQ ID NO: 25377 - DNA, 19 bp, Artificial Sequence
  Synthetic Construct
agcaggccactgctcaagt

SEQ ID NO: 25378 - DNA, 23 bp, Artificial Sequence
  Synthetic Construct
ctgagacagccacattctggtaa

SEQ ID NO: 25379 - DNA, 22 bp, Artificial Sequence
  Synthetic Construct
ctgcttccaaatcccaccttct

SEQ ID NO: 25380 - DNA, 24 bp, Artificial Sequence
  Synthetic Construct
gaagacctgtgtgagaagcaatga

SEQ ID NO: 25381 - DNA, 20 bp, Artificial Sequence
  Synthetic Construct
tagaggcacacccaccatgt

SEQ ID NO: 25382 - DNA, 19 bp, Artificial Sequence
  Synthetic Construct
agcatctccgtgcgtggaa

SEQ ID NO: 25383 - DNA, 22 bp, Artificial Sequence
  Synthetic Construct
ctgccacagaagttcaccagat

SEQ ID NO: 25384 - DNA, 23 bp, Artificial Sequence
  Synthetic Construct
gtggctttagctgaagtgctgaa

SEQ ID NO: 25385 - DNA, 22 bp, Artificial Sequence
  Synthetic Construct
tgagcatgtcagccattaccat

SEQ ID NO: 25386 - DNA, 23 bp, Artificial Sequence
  Synthetic Construct
ggctacaggaactgaatgtggat

SEQ ID NO: 25387 - DNA, 19 bp, Artificial Sequence
  Synthetic Construct
tgagggctgcccactgtag

SEQ ID NO: 25388 - DNA, 23 bp, Artificial Sequence
  Synthetic Construct
gccatctcaacctctctgtcttc

SEQ ID NO: 25389 - DNA, 21 bp, Artificial Sequence
  Synthetic Construct
gcccaaggtcactcgtttact

SEQ ID NO: 25390 - DNA, 24 bp, Artificial Sequence
  Synthetic Construct
aggactttttctctcagcacaact

SEQ ID NO: 25391 - DNA, 26 bp, Artificial Sequence
  Synthetic Construct
gactacatagtacgtctccagtgaca

SEQ ID NO: 25392 - DNA, 22 bp, Artificial Sequence
  Synthetic Construct
tgggtggtgacttgtcctgcta

SEQ ID NO: 25393 - DNA, 23 bp, Artificial Sequence
  Synthetic Construct
cctgactcctttgctaggcactt

SEQ ID NO: 25394 - DNA, 24 bp, Artificial Sequence
  Synthetic Construct
gctggtccagaggagaaatgatga

SEQ ID NO: 25395 - DNA, 19 bp, Artificial Sequence
  Synthetic Construct
ccccagcacaggcagatgt

SEQ ID NO: 25396 - DNA, 24 bp, Artificial Sequence
  Synthetic Construct
gactccccaagggataggagtatg

SEQ ID NO: 25397 - DNA, 22 bp, Artificial Sequence
  Synthetic Construct
gtgacttgagggcagaaactga

SEQ ID NO: 25398 - DNA, 25 bp, Artificial Sequence
  Synthetic Construct
cgagaagactctcccacatgtgttt

SEQ ID NO: 25399 - DNA, 24 bp, Artificial Sequence
  Synthetic Construct
cgccagagtagtgtgtctgctatt

SEQ ID NO: 25400 - DNA, 21 bp, Artificial Sequence
  Synthetic Construct
cattactggaagccgcagaga

SEQ ID NO: 25401 - DNA, 22 bp, Artificial Sequence
  Synthetic Construct
catgatgtgctgtcagcctgtt

SEQ ID NO: 25402 - DNA, 19 bp, Artificial Sequence
  Synthetic Construct
gccaacccaccgacaccat

SEQ ID NO: 25403 - DNA, 22 bp, Artificial Sequence
  Synthetic Construct
aggacctgtcaggccacataga

SEQ ID NO: 25404 - DNA, 23 bp, Artificial Sequence
  Synthetic Construct
ctggggttcaaaccctggtcttt

SEQ ID NO: 25405 - DNA, 20 bp, Artificial Sequence
  Synthetic Construct
ggctccacacatgtggcatt

SEQ ID NO: 25406 - DNA, 22 bp, Artificial Sequence
  Synthetic Construct
gaccaaggccccaagttgaagt

SEQ ID NO: 25407 - DNA, 26 bp, Artificial Sequence
  Synthetic Construct
aaaagaccccaggatggactattatg

SEQ ID NO: 25408 - DNA, 23 bp, Artificial Sequence
  Synthetic Construct
acgtacatccttgcctcttctga

SEQ ID NO: 25409 - DNA, 25 bp, Artificial Sequence
  Synthetic Construct
gctcacttgttttagctccttccta

SEQ ID NO: 25410 - DNA, 23 bp, Artificial Sequence
  Synthetic Construct
gttttgctccaggactgttttgt

SEQ ID NO: 25411 - DNA, 21 bp, Artificial Sequence
  Synthetic Construct
agcccacaagactcacctttc

SEQ ID NO: 25412 - DNA, 22 bp, Artificial Sequence
  Synthetic Construct
ctgcaggggctgagaaatgtag

SEQ ID NO: 25413 - DNA, 18 bp, Artificial Sequence
  Synthetic Construct
agcaggcacggtcagctt

SEQ ID NO: 25414 - DNA, 20 bp, Artificial Sequence
  Synthetic Construct
gcgccaaagagctggaaatg

SEQ ID NO: 25415 - DNA, 20 bp, Artificial Sequence
  Synthetic Construct
acctgggaccctctgttgaa

SEQ ID NO: 25416 - DNA, 23 bp, Artificial Sequence
  Synthetic Construct
cccatccgtatttccagacttca

SEQ ID NO: 25417 - DNA, 22 bp, Artificial Sequence
  Synthetic Construct
ggttgtggacacgtctgagttc

SEQ ID NO: 25418 - DNA, 20 bp, Artificial Sequence
  Synthetic Construct
gggcctacttccccgactct

SEQ ID NO: 25419 - DNA, 22 bp, Artificial Sequence
  Synthetic Construct
agcacagggttccctagagttg

SEQ ID NO: 25420 - DNA, 22 bp, Artificial Sequence
  Synthetic Construct
acaggctctggccaagggtaaa

SEQ ID NO: 25421 - DNA, 18 bp, Artificial Sequence
  Synthetic Construct
tgccagccgaggcaaaat

SEQ ID NO: 25422 - DNA, 26 bp, Artificial Sequence
  Synthetic Construct
gaggggattgagtcagacagatttag

SEQ ID NO: 25423 - DNA, 23 bp, Artificial Sequence
  Synthetic Construct
gcatcattcatgccacgccattg

SEQ ID NO: 25424 - DNA, 22 bp, Artificial Sequence
  Synthetic Construct
gtccaggcttggtggatgttca

SEQ ID NO: 25425 - DNA, 23 bp, Artificial Sequence
  Synthetic Construct
gaccaaaagaggcggaacacatc

SEQ ID NO: 25426 - DNA, 19 bp, Artificial Sequence
  Synthetic Construct
ggggctgggcaaattccaa

SEQ ID NO: 25427 - DNA, 24 bp, Artificial Sequence
  Synthetic Construct
cctgtcctgaatcagtgggaattt

SEQ ID NO: 25428 - DNA, 21 bp, Artificial Sequence
  Synthetic Construct
tccttgcaacgttccctgaat

SEQ ID NO: 25429 - DNA, 23 bp, Artificial Sequence
  Synthetic Construct
gttcagccactctctgctaggat

SEQ ID NO: 25430 - DNA, 20 bp, Artificial Sequence
  Synthetic Construct
tcgtcaacacggccttcact

SEQ ID NO: 25431 - DNA, 21 bp, Artificial Sequence
  Synthetic Construct
gcaagggaccaagtccacagt

SEQ ID NO: 25432 - DNA, 21 bp, Artificial Sequence
  Synthetic Construct
ttcccggggacgtgctcatct

SEQ ID NO: 25433 - DNA, 21 bp, Artificial Sequence
  Synthetic Construct
ccaggactgcctttggccttt

SEQ ID NO: 25434 - DNA, 19 bp, Artificial Sequence
  Synthetic Construct
tccctgcaagaccccttgt

SEQ ID NO: 25435 - DNA, 22 bp, Artificial Sequence
  Synthetic Construct
tgggctctggtaagcctcagtt

SEQ ID NO: 25436 - DNA, 23 bp, Artificial Sequence
  Synthetic Construct
ctccgacatctacctgtcctttc

SEQ ID NO: 25437 - DNA, 22 bp, Artificial Sequence
  Synthetic Construct
cagcaaaccagtgcaactcaac

SEQ ID NO: 25438 - DNA, 20 bp, Artificial Sequence
  Synthetic Construct
actgaccacggagtgtctga

SEQ ID NO: 25439 - DNA, 22 bp, Artificial Sequence
  Synthetic Construct
ggaaattggggccctgcattct

SEQ ID NO: 25440 - DNA, 20 bp, Artificial Sequence
  Synthetic Construct
ggtattgcagtggccaggaa

SEQ ID NO: 25441 - DNA, 22 bp, Artificial Sequence
  Synthetic Construct
gagacccagagctagagtcctt

SEQ ID NO: 25442 - DNA, 25 bp, Artificial Sequence
  Synthetic Construct
ggaaaccagattctctgagggaaaa

SEQ ID NO: 25443 - DNA, 19 bp, Artificial Sequence
  Synthetic Construct
agcagtgcgagccagtgaa

SEQ ID NO: 25444 - DNA, 23 bp, Artificial Sequence
  Synthetic Construct
ctggggcaaactacagaggatag

SEQ ID NO: 25445 - DNA, 22 bp, Artificial Sequence
  Synthetic Construct
gagaccctgtcttgcagcttag

SEQ ID NO: 25446 - DNA, 24 bp, Artificial Sequence
  Synthetic Construct
gtggacacaggggaagtaggtgaa

SEQ ID NO: 25447 - DNA, 20 bp, Artificial Sequence
  Synthetic Construct
tggccccagcagtaggtctt

SEQ ID NO: 25448 - DNA, 20 bp, Artificial Sequence
  Synthetic Construct
ggaggcagccagtgatcttt

SEQ ID NO: 25449 - DNA, 21 bp, Artificial Sequence
  Synthetic Construct
gcacagtgcttgcttctcagt

SEQ ID NO: 25450 - DNA, 20 bp, Artificial Sequence
  Synthetic Construct
atgaggcctagcagcactct

SEQ ID NO: 25451 - DNA, 24 bp, Artificial Sequence
  Synthetic Construct
gactgttggcctgtgcttaagagt

SEQ ID NO: 25452 - DNA, 20 bp, Artificial Sequence
  Synthetic Construct
tctttggccctctgcacttc

SEQ ID NO: 25453 - DNA, 20 bp, Artificial Sequence
  Synthetic Construct
cctagaccgggccgtagaag

SEQ ID NO: 25454 - DNA, 24 bp, Artificial Sequence
  Synthetic Construct
acttctcttttggcctgtttgtca

SEQ ID NO: 25455 - DNA, 20 bp, Artificial Sequence
  Synthetic Construct
gctccggtcaaaagggaagt

SEQ ID NO: 25456 - DNA, 21 bp, Artificial Sequence
  Synthetic Construct
tgtctagcgaggagcgtgtga

SEQ ID NO: 25457 - DNA, 21 bp, Artificial Sequence
  Synthetic Construct
acagtctggccacagtctctt

SEQ ID NO: 25458 - DNA, 22 bp, Artificial Sequence
  Synthetic Construct
ggtggcacagacttggagatgt

SEQ ID NO: 25459 - DNA, 22 bp, Artificial Sequence
  Synthetic Construct
ggggagttagcctgggaccaat

SEQ ID NO: 25460 - DNA, 22 bp, Artificial Sequence
  Synthetic Construct
ggcagggattcccaggagctat

SEQ ID NO: 25461 - DNA, 19 bp, Artificial Sequence
  Synthetic Construct
gctgccctccatggtctgt

SEQ ID NO: 25462 - DNA, 23 bp, Artificial Sequence
  Synthetic Construct
gcttgagaaaccctgccctagta

SEQ ID NO: 25463 - DNA, 21 bp, Artificial Sequence
  Synthetic Construct
aggggagcgcttggactatac

SEQ ID NO: 25464 - DNA, 21 bp, Artificial Sequence
  Synthetic Construct
cccggctggtagctctcagaa

SEQ ID NO: 25465 - DNA, 22 bp, Artificial Sequence
  Synthetic Construct
acctgcaagttactggagcttt

SEQ ID NO: 25466 - DNA, 19 bp, Artificial Sequence
  Synthetic Construct
aagctgcggctccttgtgt

SEQ ID NO: 25467 - DNA, 24 bp, Artificial Sequence
  Synthetic Construct
cagaacctccttcttggcaatgat

SEQ ID NO: 25468 - DNA, 22 bp, Artificial Sequence
  Synthetic Construct
cagcggcctcactcacagtatt

SEQ ID NO: 25469 - DNA, 22 bp, Artificial Sequence
  Synthetic Construct
ccctagaactgcaccgagtcat

SEQ ID NO: 25470 - DNA, 19 bp, Artificial Sequence
  Synthetic Construct
ggggtacgtcggtgtcatc

SEQ ID NO: 25471 - DNA, 24 bp, Artificial Sequence
  Synthetic Construct
ccagttttccccacagaacacgat

SEQ ID NO: 25472 - DNA, 20 bp, Artificial Sequence
  Synthetic Construct
gggaagccacagagagcaat

SEQ ID NO: 25473 - DNA, 20 bp, Artificial Sequence
  Synthetic Construct
ctgccttcctagggctgaca

SEQ ID NO: 25474 - DNA, 21 bp, Artificial Sequence
  Synthetic Construct
tgcagatgcaactgtgtccaa

SEQ ID NO: 25475 - DNA, 23 bp, Artificial Sequence
  Synthetic Construct
ggggttgcagcctagcttaactt

SEQ ID NO: 25476 - DNA, 21 bp, Artificial Sequence
  Synthetic Construct
aggaggaccgcagaatcttca

SEQ ID NO: 25477 - DNA, 20 bp, Artificial Sequence
  Synthetic Construct
ctcacactggcgggttttca

SEQ ID NO: 25478 - DNA, 20 bp, Artificial Sequence
  Synthetic Construct
gccggccagtatgccctatt

SEQ ID NO: 25479 - DNA, 23 bp, Artificial Sequence
  Synthetic Construct
ctctctctcccatttgcagaagt

SEQ ID NO: 25480 - DNA, 24 bp, Artificial Sequence
  Synthetic Construct
ggtggttgtcgatgtcaggagact

SEQ ID NO: 25481 - DNA, 27 bp, Artificial Sequence
  Synthetic Construct
ggtttctccacgtaagtaacaaagtct

SEQ ID NO: 25482 - DNA, 25 bp, Artificial Sequence
  Synthetic Construct
gggacacaattcacccataacatct

SEQ ID NO: 25483 - DNA, 25 bp, Artificial Sequence
  Synthetic Construct
ggaatctgcttcattccttgctctt

SEQ ID NO: 25484 - DNA, 20 bp, Artificial Sequence
  Synthetic Construct
acatcctgctcgaccccaaa

SEQ ID NO: 25485 - DNA, 25 bp, Artificial Sequence
  Synthetic Construct
gcagctccaaagagcagaggagata

SEQ ID NO: 25486 - DNA, 23 bp, Artificial Sequence
  Synthetic Construct
tgattaagctgcatcgtgcattg

SEQ ID NO: 25487 - DNA, 25 bp, Artificial Sequence
  Synthetic Construct
gcccaagaactccattgctaagttc

SEQ ID NO: 25488 - DNA, 24 bp, Artificial Sequence
  Synthetic Construct
acccaattcaaggagcattagcat

SEQ ID NO: 25489 - DNA, 21 bp, Artificial Sequence
  Synthetic Construct
gggtcccaatactgcaactga

SEQ ID NO: 25490 - DNA, 21 bp, Artificial Sequence
  Synthetic Construct
gatgcaccctccactggaaaa

SEQ ID NO: 25491 - DNA, 24 bp, Artificial Sequence
  Synthetic Construct
tgtgtttctgcactttgaggagtt

SEQ ID NO: 25492 - DNA, 20 bp, Artificial Sequence
  Synthetic Construct
caggtggcaggagcagacaa

SEQ ID NO: 25493 - DNA, 22 bp, Artificial Sequence
  Synthetic Construct
ggaggaagggttctgagcattc

SEQ ID NO: 25494 - DNA, 23 bp, Artificial Sequence
  Synthetic Construct
actaggtctgggagcctctcctt

SEQ ID NO: 25495 - DNA, 22 bp, Artificial Sequence
  Synthetic Construct
tacctgtggcagcccttcttca

SEQ ID NO: 25496 - DNA, 20 bp, Artificial Sequence
  Synthetic Construct
tctccagcactggtctgtct

SEQ ID NO: 25497 - DNA, 21 bp, Artificial Sequence
  Synthetic Construct
agagacgtggcactttgttga

SEQ ID NO: 25498 - DNA, 22 bp, Artificial Sequence
  Synthetic Construct
caggccagcctggtaacctaac

SEQ ID NO: 25499 - DNA, 20 bp, Artificial Sequence
  Synthetic Construct
gccacttgtcagggcatcaa

SEQ ID NO: 25500 - DNA, 21 bp, Artificial Sequence
  Synthetic Construct
aggggcctgtttgggacaatg

SEQ ID NO: 25501 - DNA, 25 bp, Artificial Sequence
  Synthetic Construct
gacagccaggtgaatgttctacaca

SEQ ID NO: 25502 - DNA, 20 bp, Artificial Sequence
  Synthetic Construct
ttgcccactcctgacctagt

SEQ ID NO: 25503 - DNA, 22 bp, Artificial Sequence
  Synthetic Construct
gcagggaccatacagactccaa

SEQ ID NO: 25504 - DNA, 23 bp, Artificial Sequence
  Synthetic Construct
cctccactccctatggtgcttag

SEQ ID NO: 25505 - DNA, 20 bp, Artificial Sequence
  Synthetic Construct
gcttgggattgcacggatca

SEQ ID NO: 25506 - DNA, 20 bp, Artificial Sequence
  Synthetic Construct
agcaggagggtgaagactgt

SEQ ID NO: 25507 - DNA, 18 bp, Artificial Sequence
  Synthetic Construct
aggccacgatggccacta

SEQ ID NO: 25508 - DNA, 21 bp, Artificial Sequence
  Synthetic Construct
ccatccatcctccaggtgttc

SEQ ID NO: 25509 - DNA, 26 bp, Artificial Sequence
  Synthetic Construct
cgtgaactctgactccttttctggat

SEQ ID NO: 25510 - DNA, 24 bp, Artificial Sequence
  Synthetic Construct
tctcaccagcttgtccctaaattc

SEQ ID NO: 25511 - DNA, 21 bp, Artificial Sequence
  Synthetic Construct
aggggaagacgtttggggtaa

SEQ ID NO: 25512 - DNA, 19 bp, Artificial Sequence
  Synthetic Construct
ccagggagcctgcacacat

SEQ ID NO: 25513 - DNA, 21 bp, Artificial Sequence
  Synthetic Construct
gtggcataggctgtcctgcat

SEQ ID NO: 25514 - DNA, 22 bp, Artificial Sequence
  Synthetic Construct
ctctctagcatgcggtgggtaa

SEQ ID NO: 25515 - DNA, 22 bp, Artificial Sequence
  Synthetic Construct
ggaaggcagtggacggtaattg

SEQ ID NO: 25516 - DNA, 24 bp, Artificial Sequence
  Synthetic Construct
gccttcccctactttactgtcgaa

SEQ ID NO: 25517 - DNA, 21 bp, Artificial Sequence
  Synthetic Construct
ggaaggagccacgcttaccaa

SEQ ID NO: 25518 - DNA, 23 bp, Artificial Sequence
  Synthetic Construct
aggaggaatactcacccctgttc

SEQ ID NO: 25519 - DNA, 25 bp, Artificial Sequence
  Synthetic Construct
tggaatggaggacaaattcctgaaa

SEQ ID NO: 25520 - DNA, 20 bp, Artificial Sequence
  Synthetic Construct
tgcctctccgccagtgtatg

SEQ ID NO: 25521 - DNA, 20 bp, Artificial Sequence
  Synthetic Construct
gagggctggacaaggtggaa

SEQ ID NO: 25522 - DNA, 24 bp, Artificial Sequence
  Synthetic Construct
ctgtggatgtgctgtgaatgttga

SEQ ID NO: 25523 - DNA, 22 bp, Artificial Sequence
  Synthetic Construct
gagttgctgggtcacggagttt

SEQ ID NO: 25524 - DNA, 24 bp, Artificial Sequence
  Synthetic Construct
ccccgagaaaacctttcagcacaa

SEQ ID NO: 25525 - DNA, 20 bp, Artificial Sequence
  Synthetic Construct
agcatcgccatcccaacaca

SEQ ID NO: 25526 - DNA, 21 bp, Artificial Sequence
  Synthetic Construct
acaggctttgccctcctatct

SEQ ID NO: 25527 - DNA, 23 bp, Artificial Sequence
  Synthetic Construct
tagccacccttcctccactgcta

SEQ ID NO: 25528 - DNA, 20 bp, Artificial Sequence
  Synthetic Construct
ttgggcctgtgaacctgtgt

SEQ ID NO: 25529 - DNA, 20 bp, Artificial Sequence
  Synthetic Construct
gggttcctccacgcacttgt

SEQ ID NO: 25530 - DNA, 21 bp, Artificial Sequence
  Synthetic Construct
ggtgcctctgggctcagtttt

SEQ ID NO: 25531 - DNA, 19 bp, Artificial Sequence
  Synthetic Construct
cgtgtccccagagcccaat

SEQ ID NO: 25532 - DNA, 19 bp, Artificial Sequence
  Synthetic Construct
tggccattcgccctactgt

SEQ ID NO: 25533 - DNA, 24 bp, Artificial Sequence
  Synthetic Construct
gtgttaggtcaaaggcagggttct

SEQ ID NO: 25534 - DNA, 24 bp, Artificial Sequence
  Synthetic Construct
gtgtagtgggttggcttaggcatt

SEQ ID NO: 25535 - DNA, 20 bp, Artificial Sequence
  Synthetic Construct
accatccagtccgagtgctt

SEQ ID NO: 25536 - DNA, 19 bp, Artificial Sequence
  Synthetic Construct
ggacgggcaatgtccatgt

SEQ ID NO: 25537 - DNA, 22 bp, Artificial Sequence
  Synthetic Construct
caggccacacacccctttatct

SEQ ID NO: 25538 - DNA, 22 bp, Artificial Sequence
  Synthetic Construct
ccggaatccctcagcaaagtct

SEQ ID NO: 25539 - DNA, 22 bp, Artificial Sequence
  Synthetic Construct
ggcatagcagacactgccgatt

SEQ ID NO: 25540 - DNA, 25 bp, Artificial Sequence
  Synthetic Construct
cccctgcatctatccattcctattc

SEQ ID NO: 25541 - DNA, 22 bp, Artificial Sequence
  Synthetic Construct
atctcctctgctgcgtgacaag

SEQ ID NO: 25542 - DNA, 22 bp, Artificial Sequence
  Synthetic Construct
ctgtacatgtggctggaacaga

SEQ ID NO: 25543 - DNA, 20 bp, Artificial Sequence
  Synthetic Construct
tccaggacgtggcacaaagt

SEQ ID NO: 25544 - DNA, 23 bp, Artificial Sequence
  Synthetic Construct
ctcttccgtctcctcctgcaaac

SEQ ID NO: 25545 - DNA, 21 bp, Artificial Sequence
  Synthetic Construct
tccaatcgcctgtctgtgttc

SEQ ID NO: 25546 - DNA, 22 bp, Artificial Sequence
  Synthetic Construct
cctcacattgccatccaagcat

SEQ ID NO: 25547 - DNA, 25 bp, Artificial Sequence
  Synthetic Construct
gtccacgtgggtttaaattcagcta

SEQ ID NO: 25548 - DNA, 22 bp, Artificial Sequence
  Synthetic Construct
cacagacacagccccaaacaca

SEQ ID NO: 25549 - DNA, 21 bp, Artificial Sequence
  Synthetic Construct
ttggccaaggggacccaagaa

SEQ ID NO: 25550 - DNA, 21 bp, Artificial Sequence
  Synthetic Construct
agtgttggcgtggaggtctct

SEQ ID NO: 25551 - DNA, 19 bp, Artificial Sequence
  Synthetic Construct
caggcaggctgcacacaaa

SEQ ID NO: 25552 - DNA, 18 bp, Artificial Sequence
  Synthetic Construct
cagcgccacatgcacagt

SEQ ID NO: 25553 - DNA, 19 bp, Artificial Sequence
  Synthetic Construct
tgtgcgtgcactccgtgat

SEQ ID NO: 25554 - DNA, 19 bp, Artificial Sequence
  Synthetic Construct
accctgccctgctggacta

SEQ ID NO: 25555 - DNA, 22 bp, Artificial Sequence
  Synthetic Construct
gggtcctcttgccattcgttca

SEQ ID NO: 25556 - DNA, 20 bp, Artificial Sequence
  Synthetic Construct
tccactccctgcgcctcaca

SEQ ID NO: 25557 - DNA, 19 bp, Artificial Sequence
  Synthetic Construct
ctgcgtccgggagtcatgt

SEQ ID NO: 25558 - DNA, 20 bp, Artificial Sequence
  Synthetic Construct
tgcgcgatgctgcaagatgt

SEQ ID NO: 25559 - DNA, 20 bp, Artificial Sequence
  Synthetic Construct
acatggaggcgagagtcaga

SEQ ID NO: 25560 - DNA, 21 bp, Artificial Sequence
  Synthetic Construct
aggccttcctgaggcttcgat

SEQ ID NO: 25561 - DNA, 20 bp, Artificial Sequence
  Synthetic Construct
gcccagtccggaagggttct

SEQ ID NO: 25562 - DNA, 22 bp, Artificial Sequence
  Synthetic Construct
ggtgcacttggagtcacagaca

SEQ ID NO: 25563 - DNA, 21 bp, Artificial Sequence
  Synthetic Construct
gccaccacgccaagaaaggaa

SEQ ID NO: 25564 - DNA, 21 bp, Artificial Sequence
  Synthetic Construct
ggcaacccagtgctgaggaat

SEQ ID NO: 25565 - DNA, 18 bp, Artificial Sequence
  Synthetic Construct
tgctcggcgtgtctgcaa

SEQ ID NO: 25566 - DNA, 20 bp, Artificial Sequence
  Synthetic Construct
gtgcttccctgccggactac

SEQ ID NO: 25567 - DNA, 21 bp, Artificial Sequence
  Synthetic Construct
aggggtctggctgagcatatc

SEQ ID NO: 25568 - DNA, 22 bp, Artificial Sequence
  Synthetic Construct
ggaggtccttccttgcctcaat

SEQ ID NO: 25569 - DNA, 23 bp, Artificial Sequence
  Synthetic Construct
gtgggccctttattgaccaggtt

SEQ ID NO: 25570 - DNA, 18 bp, Artificial Sequence
  Synthetic Construct
gcggcctcaggaaacctt

SEQ ID NO: 25571 - DNA, 20 bp, Artificial Sequence
  Synthetic Construct
atgctcccctccctgtccat

SEQ ID NO: 25572 - DNA, 20 bp, Artificial Sequence
  Synthetic Construct
gcgagtcccatctgctcttc

SEQ ID NO: 25573 - DNA, 18 bp, Artificial Sequence
  Synthetic Construct
aggctctgggctccttgt

SEQ ID NO: 25574 - DNA, 22 bp, Artificial Sequence
  Synthetic Construct
gacttcagggcctccaaccatt

SEQ ID NO: 25575 - DNA, 22 bp, Artificial Sequence
  Synthetic Construct
tcccctgcaccacttctcagat

SEQ ID NO: 25576 - DNA, 19 bp, Artificial Sequence
  Synthetic Construct
tgggtgctgggtgcacagt

SEQ ID NO: 25577 - DNA, 18 bp, Artificial Sequence
  Synthetic Construct
ggaacggccctgccaaat

SEQ ID NO: 25578 - DNA, 18 bp, Artificial Sequence
  Synthetic Construct
agtgagcgtcccgtggtt

SEQ ID NO: 25579 - DNA, 22 bp, Artificial Sequence
  Synthetic Construct
gtggcaaggacaagctgtatct

SEQ ID NO: 25580 - DNA, 19 bp, Artificial Sequence
  Synthetic Construct
agccacccgtgctctcaac

SEQ ID NO: 25581 - DNA, 24 bp, Artificial Sequence
  Synthetic Construct
cctgtggctcctctggactttatc

SEQ ID NO: 25582 - DNA, 20 bp, Artificial Sequence
  Synthetic Construct
ggcttgagcttgcagtcttg

SEQ ID NO: 25583 - DNA, 21 bp, Artificial Sequence
  Synthetic Construct
gctccctgaagggcagtgaag

SEQ ID NO: 25584 - DNA, 23 bp, Artificial Sequence
  Synthetic Construct
gctcttgtggagaaggagacaga

SEQ ID NO: 25585 - DNA, 18 bp, Artificial Sequence
  Synthetic Construct
tgctggggcaacctcgat

SEQ ID NO: 25586 - DNA, 21 bp, Artificial Sequence
  Synthetic Construct
tgcactgccctagagctgcat

SEQ ID NO: 25587 - DNA, 20 bp, Artificial Sequence
  Synthetic Construct
accccgcctcactcggatgt

SEQ ID NO: 25588 - DNA, 24 bp, Artificial Sequence
  Synthetic Construct
tcctctctcctctgtggagtttta

SEQ ID NO: 25589 - DNA, 20 bp, Artificial Sequence
  Synthetic Construct
tcgcacgtccctgctacaag

SEQ ID NO: 25590 - DNA, 21 bp, Artificial Sequence
  Synthetic Construct
cacagtggcagttccggatga

SEQ ID NO: 25591 - DNA, 27 bp, Artificial Sequence
  Synthetic Construct
tgacgaatcagagaatatgacctgtag

SEQ ID NO: 25592 - DNA, 24 bp, Artificial Sequence
  Synthetic Construct
gccaggctcagactcatcatcttg

SEQ ID NO: 25593 - DNA, 20 bp, Artificial Sequence
  Synthetic Construct
tggatgaggccctgttctgt

SEQ ID NO: 25594 - DNA, 22 bp, Artificial Sequence
  Synthetic Construct
tccagcttcctcaaggcagtca

SEQ ID NO: 25595 - DNA, 20 bp, Artificial Sequence
  Synthetic Construct
ccagccaagaagcagcaaca

SEQ ID NO: 25596 - DNA, 21 bp, Artificial Sequence
  Synthetic Construct
cacggccttgctttcctgaga

SEQ ID NO: 25597 - DNA, 20 bp, Artificial Sequence
  Synthetic Construct
aggccccggagggaaaagaa

SEQ ID NO: 25598 - DNA, 21 bp, Artificial Sequence
  Synthetic Construct
gaggactgtgccagggaagta

SEQ ID NO: 25599 - DNA, 20 bp, Artificial Sequence
  Synthetic Construct
tgctggacagacgcccagtt

SEQ ID NO: 25600 - DNA, 23 bp, Artificial Sequence
  Synthetic Construct
gtcctcaggtcccagtggtagta

SEQ ID NO: 25601 - DNA, 22 bp, Artificial Sequence
  Synthetic Construct
gtgcttccctttttgccctcta

SEQ ID NO: 25602 - DNA, 21 bp, Artificial Sequence
  Synthetic Construct
ggagaggggcttgggaagtga

SEQ ID NO: 25603 - DNA, 22 bp, Artificial Sequence
  Synthetic Construct
ctgccagcacacctatgtgata

SEQ ID NO: 25604 - DNA, 22 bp, Artificial Sequence
  Synthetic Construct
gaagttccccagtgctcaccaa

SEQ ID NO: 25605 - DNA, 22 bp, Artificial Sequence
  Synthetic Construct
cctcaccagctcccaacgtttt

SEQ ID NO: 25606 - DNA, 18 bp, Artificial Sequence
  Synthetic Construct
tccacaccggcccatcat

SEQ ID NO: 25607 - DNA, 21 bp, Artificial Sequence
  Synthetic Construct
tgaagcacaggtgggaagaag

SEQ ID NO: 25608 - DNA, 24 bp, Artificial Sequence
  Synthetic Construct
agagaatggaagagaagggactgt

SEQ ID NO: 25609 - DNA, 21 bp, Artificial Sequence
  Synthetic Construct
agaggctccacccgtcttctt

SEQ ID NO: 25610 - DNA, 25 bp, Artificial Sequence
  Synthetic Construct
tgaacagatggctacgaatgtatga

SEQ ID NO: 25611 - DNA, 22 bp, Artificial Sequence
  Synthetic Construct
accctggtcaagagggaagtca

SEQ ID NO: 25612 - DNA, 19 bp, Artificial Sequence
  Synthetic Construct
cagcctggcttgcccaaag

SEQ ID NO: 25613 - DNA, 21 bp, Artificial Sequence
  Synthetic Construct
tggcaggttctgggcttcatc

SEQ ID NO: 25614 - DNA, 22 bp, Artificial Sequence
  Synthetic Construct
aggggatggcctcttgaacaca

SEQ ID NO: 25615 - DNA, 23 bp, Artificial Sequence
  Synthetic Construct
tggagctgtttctcctagtgtct

SEQ ID NO: 25616 - DNA, 20 bp, Artificial Sequence
  Synthetic Construct
gcctgtcagcaggcagactt

SEQ ID NO: 25617 - DNA, 23 bp, Artificial Sequence
  Synthetic Construct
cctttggctgtgtaggcttcgat

SEQ ID NO: 25618 - DNA, 22 bp, Artificial Sequence
  Synthetic Construct
ggtgggtctccaggtcactgaa

SEQ ID NO: 25619 - DNA, 22 bp, Artificial Sequence
  Synthetic Construct
tgaagacagcctcccactctct

SEQ ID NO: 25620 - DNA, 21 bp, Artificial Sequence
  Synthetic Construct
gccggggccaactatttgcta

SEQ ID NO: 25621 - DNA, 21 bp, Artificial Sequence
  Synthetic Construct
gcagggagcagggaaggaagt

SEQ ID NO: 25622 - DNA, 22 bp, Artificial Sequence
  Synthetic Construct
ctggggcagctgaggaatactt

SEQ ID NO: 25623 - DNA, 23 bp, Artificial Sequence
  Synthetic Construct
catgaacctgcaatttggctgat

SEQ ID NO: 25624 - DNA, 22 bp, Artificial Sequence
  Synthetic Construct
ccagcccaggtttgctgaatgt

SEQ ID NO: 25625 - DNA, 24 bp, Artificial Sequence
  Synthetic Construct
tcagtcctgagctggaaataccta

SEQ ID NO: 25626 - DNA, 22 bp, Artificial Sequence
  Synthetic Construct
cccacacccatcttgggtcttt

SEQ ID NO: 25627 - DNA, 19 bp, Artificial Sequence
  Synthetic Construct
aaggcccagcagggaggaa

SEQ ID NO: 25628 - DNA, 22 bp, Artificial Sequence
  Synthetic Construct
ggcatgtttgtcgtggggatgt

SEQ ID NO: 25629 - DNA, 24 bp, Artificial Sequence
  Synthetic Construct
tctcaaactgagcattagctcctt

SEQ ID NO: 25630 - DNA, 22 bp, Artificial Sequence
  Synthetic Construct
accacaggactggatgggaaaa

SEQ ID NO: 25631 - DNA, 23 bp, Artificial Sequence
  Synthetic Construct
ggaggaatgatggggaagtctgt

SEQ ID NO: 25632 - DNA, 20 bp, Artificial Sequence
  Synthetic Construct
ccctgtggcgagatccacat

SEQ ID NO: 25633 - DNA, 22 bp, Artificial Sequence
  Synthetic Construct
ggatccttggggtgtcgtttca

SEQ ID NO: 25634 - DNA, 24 bp, Artificial Sequence
  Synthetic Construct
gctcctgttgttactgggtaggtt

SEQ ID NO: 25635 - DNA, 25 bp, Artificial Sequence
  Synthetic Construct
cctctcctctttgtggtccttcaac

SEQ ID NO: 25636 - DNA, 24 bp, Artificial Sequence
  Synthetic Construct
cagtgtgataggtttccgtgaact

SEQ ID NO: 25637 - DNA, 21 bp, Artificial Sequence
  Synthetic Construct
tcagccccttcacccaactaa

SEQ ID NO: 25638 - DNA, 23 bp, Artificial Sequence
  Synthetic Construct
ggtgaccacccctgaataaccat

SEQ ID NO: 25639 - DNA, 25 bp, Artificial Sequence
  Synthetic Construct
agctctttcaggtacaagagtgaaa

SEQ ID NO: 25640 - DNA, 20 bp, Artificial Sequence
  Synthetic Construct
agcagcagcctcttgctagt

SEQ ID NO: 25641 - DNA, 22 bp, Artificial Sequence
  Synthetic Construct
gccccatcagcgatgtggaata

SEQ ID NO: 25642 - DNA, 23 bp, Artificial Sequence
  Synthetic Construct
ctctgaaacctggggaaatgcaa

SEQ ID NO: 25643 - DNA, 22 bp, Artificial Sequence
  Synthetic Construct
ctgccagttttgttgccctttt

SEQ ID NO: 25644 - DNA, 24 bp, Artificial Sequence
  Synthetic Construct
caggtcaatggacggttaggtaca

SEQ ID NO: 25645 - DNA, 23 bp, Artificial Sequence
  Synthetic Construct
caaaggcagagacttccctgatg

SEQ ID NO: 25646 - DNA, 23 bp, Artificial Sequence
  Synthetic Construct
acctcctccttcccgattaaact

SEQ ID NO: 25647 - DNA, 20 bp, Artificial Sequence
  Synthetic Construct
ggagaccgcagctccagtta

SEQ ID NO: 25648 - DNA, 20 bp, Artificial Sequence
  Synthetic Construct
ggtctcgggaagccaacaat

SEQ ID NO: 25649 - DNA, 20 bp, Artificial Sequence
  Synthetic Construct
aggccagcagccagaagttt

SEQ ID NO: 25650 - DNA, 24 bp, Artificial Sequence
  Synthetic Construct
cccctagaaacagacccactaatc

SEQ ID NO: 25651 - DNA, 23 bp, Artificial Sequence
  Synthetic Construct
tgacttccacggtacacatctga

SEQ ID NO: 25652 - DNA, 21 bp, Artificial Sequence
  Synthetic Construct
accgctgcaaataggcactac

SEQ ID NO: 25653 - DNA, 23 bp, Artificial Sequence
  Synthetic Construct
cctaggagaatggcactggctta

SEQ ID NO: 25654 - DNA, 24 bp, Artificial Sequence
  Synthetic Construct
gtatggtagtcacgcaacacaaaa

SEQ ID NO: 25655 - DNA, 20 bp, Artificial Sequence
  Synthetic Construct
acacggagggcatcgtgttg

SEQ ID NO: 25656 - DNA, 21 bp, Artificial Sequence
  Synthetic Construct
ccctgctctccctgtcccata

SEQ ID NO: 25657 - DNA, 24 bp, Artificial Sequence
  Synthetic Construct
gtgcaggtgacataccaagctgtt

SEQ ID NO: 25658 - DNA, 19 bp, Artificial Sequence
  Synthetic Construct
gtgtggccccaagggtgtt

SEQ ID NO: 25659 - DNA, 20 bp, Artificial Sequence
  Synthetic Construct
ctgctctgcccacacaaaca

SEQ ID NO: 25660 - DNA, 22 bp, Artificial Sequence
  Synthetic Construct
caggaacctgaggcatggaatc

SEQ ID NO: 25661 - DNA, 20 bp, Artificial Sequence
  Synthetic Construct
gtgcatggaagctgggcttt

SEQ ID NO: 25662 - DNA, 20 bp, Artificial Sequence
  Synthetic Construct
cccaactgctccccttgctt

SEQ ID NO: 25663 - DNA, 22 bp, Artificial Sequence
  Synthetic Construct
acctcttggtggaagtggacat

SEQ ID NO: 25664 - DNA, 20 bp, Artificial Sequence
  Synthetic Construct
aggtgagagccagctggaaa

SEQ ID NO: 25665 - DNA, 25 bp, Artificial Sequence
  Synthetic Construct
gactttgagatcgctgactgattct

SEQ ID NO: 25666 - DNA, 20 bp, Artificial Sequence
  Synthetic Construct
ggcaaaaccctggctctact

SEQ ID NO: 25667 - DNA, 19 bp, Artificial Sequence
  Synthetic Construct
agcccctgctcccaaggta

SEQ ID NO: 25668 - DNA, 23 bp, Artificial Sequence
  Synthetic Construct
tgaagccactgaaggtagctttt

SEQ ID NO: 25669 - DNA, 20 bp, Artificial Sequence
  Synthetic Construct
tcaggtgccagctccagaaa

SEQ ID NO: 25670 - DNA, 26 bp, Artificial Sequence
  Synthetic Construct
tcttgggatcctgaactgtcttaatc

SEQ ID NO: 25671 - DNA, 27 bp, Artificial Sequence
  Synthetic Construct
cagtatcctcaccttggtctagacttt

SEQ ID NO: 25672 - DNA, 24 bp, Artificial Sequence
  Synthetic Construct
ccaaattgacccactaggtgttgt

SEQ ID NO: 25673 - DNA, 22 bp, Artificial Sequence
  Synthetic Construct
tccactggaagtggcagaaaat

SEQ ID NO: 25674 - DNA, 20 bp, Artificial Sequence
  Synthetic Construct
agggccaggtaggccctcat

SEQ ID NO: 25675 - DNA, 20 bp, Artificial Sequence
  Synthetic Construct
ggcagatagcctgccccaaa

SEQ ID NO: 25676 - DNA, 27 bp, Artificial Sequence
  Synthetic Construct
cattttactggggaagaaatggagact

SEQ ID NO: 25677 - DNA, 22 bp, Artificial Sequence
  Synthetic Construct
cccaatgcctggctcctaattc

SEQ ID NO: 25678 - DNA, 22 bp, Artificial Sequence
  Synthetic Construct
tacagcgactgctgccaggtat

SEQ ID NO: 25679 - DNA, 24 bp, Artificial Sequence
  Synthetic Construct
gctggacagtgttgaaagccatag

SEQ ID NO: 25680 - DNA, 21 bp, Artificial Sequence
  Synthetic Construct
acctcctcctgccacaggatt

SEQ ID NO: 25681 - DNA, 24 bp, Artificial Sequence
  Synthetic Construct
cagggaaagtgacacactccagaa

SEQ ID NO: 25682 - DNA, 24 bp, Artificial Sequence
  Synthetic Construct
gctgggattgccttcttgttttca

SEQ ID NO: 25683 - DNA, 26 bp, Artificial Sequence
  Synthetic Construct
cgatagacagatccccactttacatc

SEQ ID NO: 25684 - DNA, 25 bp, Artificial Sequence
  Synthetic Construct
gcagaaactgtcagactcctacttc

SEQ ID NO: 25685 - DNA, 22 bp, Artificial Sequence
  Synthetic Construct
gtgttgcaaaccaacccacaga

SEQ ID NO: 25686 - DNA, 20 bp, Artificial Sequence
  Synthetic Construct
gcctgggctagacacacact

SEQ ID NO: 25687 - DNA, 20 bp, Artificial Sequence
  Synthetic Construct
gctggctgctgttactgaga

SEQ ID NO: 25688 - DNA, 24 bp, Artificial Sequence
  Synthetic Construct
tcatagggctttgcattcagtgat

SEQ ID NO: 25689 - DNA, 22 bp, Artificial Sequence
  Synthetic Construct
cacaggggtcacacttcgatct

SEQ ID NO: 25690 - DNA, 22 bp, Artificial Sequence
  Synthetic Construct
ccctctgtctcagcgtttccta

SEQ ID NO: 25691 - DNA, 22 bp, Artificial Sequence
  Synthetic Construct
ggttgggttccttgctctctct

SEQ ID NO: 25692 - DNA, 23 bp, Artificial Sequence
  Synthetic Construct
gatgttaggttgggttgcagaca

SEQ ID NO: 25693 - DNA, 20 bp, Artificial Sequence
  Synthetic Construct
agtgccctttgaggcaggat

SEQ ID NO: 25694 - DNA, 20 bp, Artificial Sequence
  Synthetic Construct
agccccacatcctgcgtaag

SEQ ID NO: 25695 - DNA, 20 bp, Artificial Sequence
  Synthetic Construct
ttccgcaccacgtccacaac

SEQ ID NO: 25696 - DNA, 18 bp, Artificial Sequence
  Synthetic Construct
tccgacaggacgcacaca

SEQ ID NO: 25697 - DNA, 20 bp, Artificial Sequence
  Synthetic Construct
ccggagagcagggtgtgatg

SEQ ID NO: 25698 - DNA, 21 bp, Artificial Sequence
  Synthetic Construct
tggagggcctctggtcacttc

SEQ ID NO: 25699 - DNA, 24 bp, Artificial Sequence
  Synthetic Construct
gcagagattagtgccaccatcaag

SEQ ID NO: 25700 - DNA, 22 bp, Artificial Sequence
  Synthetic Construct
agtgactgtgcattgtgggaaa

SEQ ID NO: 25701 - DNA, 25 bp, Artificial Sequence
  Synthetic Construct
caaatccagaccaattgagcaaaga

SEQ ID NO: 25702 - DNA, 26 bp, Artificial Sequence
  Synthetic Construct
gggaggaaggagggaaagagattttg

SEQ ID NO: 25703 - DNA, 22 bp, Artificial Sequence
  Synthetic Construct
gcatagctgggcctatttctct

SEQ ID NO: 25704 - DNA, 22 bp, Artificial Sequence
  Synthetic Construct
gcgggatggagtgagagtgttt

SEQ ID NO: 25705 - DNA, 19 bp, Artificial Sequence
  Synthetic Construct
ggcacagcagctccagaat

SEQ ID NO: 25706 - DNA, 20 bp, Artificial Sequence
  Synthetic Construct
ttcccaccgccgacttccaa

SEQ ID NO: 25707 - DNA, 22 bp, Artificial Sequence
  Synthetic Construct
ccaagtagcagggctggctaaa

SEQ ID NO: 25708 - DNA, 20 bp, Artificial Sequence
  Synthetic Construct
agcccaggctgactggtttg

SEQ ID NO: 25709 - DNA, 21 bp, Artificial Sequence
  Synthetic Construct
aagctggggtggactccgtta

SEQ ID NO: 25710 - DNA, 18 bp, Artificial Sequence
  Synthetic Construct
aggcaggctggctgcaaa

SEQ ID NO: 25711 - DNA, 22 bp, Artificial Sequence
  Synthetic Construct
ggacagcaaccgttcagagact

SEQ ID NO: 25712 - DNA, 20 bp, Artificial Sequence
  Synthetic Construct
tggtggtggctggcacagta

SEQ ID NO: 25713 - DNA, 21 bp, Artificial Sequence
  Synthetic Construct
agccatcgtggggtctcttac

SEQ ID NO: 25714 - DNA, 22 bp, Artificial Sequence
  Synthetic Construct
gtctttccatttgcctggcatt

SEQ ID NO: 25715 - DNA, 21 bp, Artificial Sequence
  Synthetic Construct
agctccgcctcttaaccctaa

SEQ ID NO: 25716 - DNA, 20 bp, Artificial Sequence
  Synthetic Construct
cagtggcattgcagggcttt

SEQ ID NO: 25717 - DNA, 21 bp, Artificial Sequence
  Synthetic Construct
aggaaaaggccatcccaggaa

SEQ ID NO: 25718 - DNA, 20 bp, Artificial Sequence
  Synthetic Construct
tggagggaagaggtgtgtgt

SEQ ID NO: 25719 - DNA, 18 bp, Artificial Sequence
  Synthetic Construct
ggggccacagcaaagcat

SEQ ID NO: 25720 - DNA, 20 bp, Artificial Sequence
  Synthetic Construct
accttcctgtgcacccacaa

SEQ ID NO: 25721 - DNA, 24 bp, Artificial Sequence
  Synthetic Construct
cagagatgacctcagagccttttg

SEQ ID NO: 25722 - DNA, 20 bp, Artificial Sequence
  Synthetic Construct
gcacaggcactgggctaaac

SEQ ID NO: 25723 - DNA, 18 bp, Artificial Sequence
  Synthetic Construct
ttggtggcgcctcagatg

SEQ ID NO: 25724 - DNA, 19 bp, Artificial Sequence
  Synthetic Construct
actgcctggctcagtgaca

SEQ ID NO: 25725 - DNA, 26 bp, Artificial Sequence
  Synthetic Construct
gggagggcagcaataataacctctga

SEQ ID NO: 25726 - DNA, 25 bp, Artificial Sequence
  Synthetic Construct
cagatccacaaacctagggagtgtt

SEQ ID NO: 25727 - DNA, 23 bp, Artificial Sequence
  Synthetic Construct
agggtgtatgtgtgtctgacaag

SEQ ID NO: 25728 - DNA, 22 bp, Artificial Sequence
  Synthetic Construct
cactgggtaggggagcgatact

SEQ ID NO: 25729 - DNA, 24 bp, Artificial Sequence
  Synthetic Construct
gactatgaaaatctgccgctggat

SEQ ID NO: 25730 - DNA, 21 bp, Artificial Sequence
  Synthetic Construct
tggactgaccacgtgcaggat

SEQ ID NO: 25731 - DNA, 20 bp, Artificial Sequence
  Synthetic Construct
tcctctgcgccccatctgaa

SEQ ID NO: 25732 - DNA, 20 bp, Artificial Sequence
  Synthetic Construct
ctcggggaaccatgggctaa

SEQ ID NO: 25733 - DNA, 23 bp, Artificial Sequence
  Synthetic Construct
tttgccctgagaactgagagttt

SEQ ID NO: 25734 - DNA, 23 bp, Artificial Sequence
  Synthetic Construct
cccggaagcagcacatgagataa

SEQ ID NO: 25735 - DNA, 22 bp, Artificial Sequence
  Synthetic Construct
ctgcctgagggtagctttggta

SEQ ID NO: 25736 - DNA, 23 bp, Artificial Sequence
  Synthetic Construct
catgtcctagcacaggtctctct

SEQ ID NO: 25737 - DNA, 20 bp, Artificial Sequence
  Synthetic Construct
agtgccgagacctggaagtt

SEQ ID NO: 25738 - DNA, 19 bp, Artificial Sequence
  Synthetic Construct
cggacggctcgggtacttt

SEQ ID NO: 25739 - DNA, 20 bp, Artificial Sequence
  Synthetic Construct
ggggctcccaggagacatca

SEQ ID NO: 25740 - DNA, 25 bp, Artificial Sequence
  Synthetic Construct
tgtctgaagtttcctacccatttgt

SEQ ID NO: 25741 - DNA, 22 bp, Artificial Sequence
  Synthetic Construct
agtgagtcacaccgacttctga

SEQ ID NO: 25742 - DNA, 19 bp, Artificial Sequence
  Synthetic Construct
gcacggccgagctcattca

SEQ ID NO: 25743 - DNA, 20 bp, Artificial Sequence
  Synthetic Construct
actcccggctggtgctcaca

SEQ ID NO: 25744 - DNA, 23 bp, Artificial Sequence
  Synthetic Construct
tcacccagctaggaaggattttg

SEQ ID NO: 25745 - DNA, 21 bp, Artificial Sequence
  Synthetic Construct
gggtttctccaggcggtaaag

SEQ ID NO: 25746 - DNA, 21 bp, Artificial Sequence
  Synthetic Construct
ggcgagttccactcatagcaa

SEQ ID NO: 25747 - DNA, 20 bp, Artificial Sequence
  Synthetic Construct
cgctggccttgtgctttaga

SEQ ID NO: 25748 - DNA, 20 bp, Artificial Sequence
  Synthetic Construct
ttgggctgtgcgcattcact

SEQ ID NO: 25749 - DNA, 20 bp, Artificial Sequence
  Synthetic Construct
ggtgcccatggcatgactgt

SEQ ID NO: 25750 - DNA, 18 bp, Artificial Sequence
  Synthetic Construct
ggtgggtgtgtgcgtgta

SEQ ID NO: 25751 - DNA, 24 bp, Artificial Sequence
  Synthetic Construct
ggcagattctatccccatgtcact

SEQ ID NO: 25752 - DNA, 24 bp, Artificial Sequence
  Synthetic Construct
cagccactgttatgtcagcaggaa

SEQ ID NO: 25753 - DNA, 19 bp, Artificial Sequence
  Synthetic Construct
aaggctgtgcgctggtttg

SEQ ID NO: 25754 - DNA, 18 bp, Artificial Sequence
  Synthetic Construct
tgcaccgggcacaaatga

SEQ ID NO: 25755 - DNA, 23 bp, Artificial Sequence
  Synthetic Construct
gtcagttctgcttcacgggtttc

SEQ ID NO: 25756 - DNA, 24 bp, Artificial Sequence
  Synthetic Construct
agatgacatcaaggtggctagttc

SEQ ID NO: 25757 - DNA, 23 bp, Artificial Sequence
  Synthetic Construct
cggacagcatagacctgttgagt

SEQ ID NO: 25758 - DNA, 23 bp, Artificial Sequence
  Synthetic Construct
aatgggaccagagggtctaagaa

SEQ ID NO: 25759 - DNA, 25 bp, Artificial Sequence
  Synthetic Construct
cgggtaagaactgggtgaagataag

SEQ ID NO: 25760 - DNA, 22 bp, Artificial Sequence
  Synthetic Construct
ccagtgcctacagtcccagcta

SEQ ID NO: 25761 - DNA, 21 bp, Artificial Sequence
  Synthetic Construct
tcgggaagtagcaggaactga

SEQ ID NO: 25762 - DNA, 20 bp, Artificial Sequence
  Synthetic Construct
cactgtgaggggagcgtaca

SEQ ID NO: 25763 - DNA, 22 bp, Artificial Sequence
  Synthetic Construct
tctctgaggtgggtgctggaaa

SEQ ID NO: 25764 - DNA, 25 bp, Artificial Sequence
  Synthetic Construct
ggaggactctatgcatctggggtta

SEQ ID NO: 25765 - DNA, 20 bp, Artificial Sequence
  Synthetic Construct
tgaaagccctggcccaatga

SEQ ID NO: 25766 - DNA, 25 bp, Artificial Sequence
  Synthetic Construct
aacccatctcagcttccttgttaat

SEQ ID NO: 25767 - DNA, 22 bp, Artificial Sequence
  Synthetic Construct
ggcacatccgcaatcagtgcat

SEQ ID NO: 25768 - DNA, 18 bp, Artificial Sequence
  Synthetic Construct
agtgcctgcctggcgaat

SEQ ID NO: 25769 - DNA, 26 bp, Artificial Sequence
  Synthetic Construct
gaagggtgtaggtaaaagcctagttg

SEQ ID NO: 25770 - DNA, 19 bp, Artificial Sequence
  Synthetic Construct
tgcagcaggaagtggcaaa

SEQ ID NO: 25771 - DNA, 23 bp, Artificial Sequence
  Synthetic Construct
agtgcttcacatcgaggaagatg

SEQ ID NO: 25772 - DNA, 19 bp, Artificial Sequence
  Synthetic Construct
aggggaagctgccgagttc

SEQ ID NO: 25773 - DNA, 22 bp, Artificial Sequence
  Synthetic Construct
ccagggaaccccagaatcatca

SEQ ID NO: 25774 - DNA, 25 bp, Artificial Sequence
  Synthetic Construct
tgcaaagacaaaggtaagtgtgttg

SEQ ID NO: 25775 - DNA, 23 bp, Artificial Sequence
  Synthetic Construct
gggtgtgtgcactctacgtttct

SEQ ID NO: 25776 - DNA, 19 bp, Artificial Sequence
  Synthetic Construct
tgggcggtgacctggcttt

SEQ ID NO: 25777 - DNA, 21 bp, Artificial Sequence
  Synthetic Construct
tgcctggagagctgctgtcat

SEQ ID NO: 25778 - DNA, 20 bp, Artificial Sequence
  Synthetic Construct
caggccctgtgggtctgttg

SEQ ID NO: 25779 - DNA, 19 bp, Artificial Sequence
  Synthetic Construct
tgccgtggtgtggggatct

SEQ ID NO: 25780 - DNA, 23 bp, Artificial Sequence
  Synthetic Construct
tttccccatcacactttcgttct

SEQ ID NO: 25781 - DNA, 23 bp, Artificial Sequence
  Synthetic Construct
ggctgtgggacttgttacagtga

SEQ ID NO: 25782 - DNA, 21 bp, Artificial Sequence
  Synthetic Construct
gcttgccagctccacatccaa

SEQ ID NO: 25783 - DNA, 19 bp, Artificial Sequence
  Synthetic Construct
tccgcccacaggcctcttt

SEQ ID NO: 25784 - DNA, 21 bp, Artificial Sequence
  Synthetic Construct
gccgggcagagagtagaggat

SEQ ID NO: 25785 - DNA, 22 bp, Artificial Sequence
  Synthetic Construct
gggagctgcagagacgagtttt

SEQ ID NO: 25786 - DNA, 23 bp, Artificial Sequence
  Synthetic Construct
ggcatcgtaaaggctgccagtag

SEQ ID NO: 25787 - DNA, 20 bp, Artificial Sequence
  Synthetic Construct
actggcacagctggtagact

SEQ ID NO: 25788 - DNA, 24 bp, Artificial Sequence
  Synthetic Construct
ccctcaacccgtttccttaagtgt

SEQ ID NO: 25789 - DNA, 20 bp, Artificial Sequence
  Synthetic Construct
taggagcatggacgcaggaa

SEQ ID NO: 25790 - DNA, 20 bp, Artificial Sequence
  Synthetic Construct
ggctgaagggtccccacaaa

SEQ ID NO: 25791 - DNA, 20 bp, Artificial Sequence
  Synthetic Construct
tgccaccatcttgcccttgt

SEQ ID NO: 25792 - DNA, 21 bp, Artificial Sequence
  Synthetic Construct
gttgggcgaactgtactccat

SEQ ID NO: 25793 - DNA, 20 bp, Artificial Sequence
  Synthetic Construct
ctgccacaacagggacaaga

SEQ ID NO: 25794 - DNA, 22 bp, Artificial Sequence
  Synthetic Construct
agtaaaacaggcaggcaacaga

SEQ ID NO: 25795 - DNA, 25 bp, Artificial Sequence
  Synthetic Construct
gttgagcccttgttatgtgtgtaga

SEQ ID NO: 25796 - DNA, 21 bp, Artificial Sequence
  Synthetic Construct
agggtaggcagaggtgcttca

SEQ ID NO: 25797 - DNA, 18 bp, Artificial Sequence
  Synthetic Construct
cgtgtgaccaggctgcaa

SEQ ID NO: 25798 - DNA, 20 bp, Artificial Sequence
  Synthetic Construct
gggatgacgtcggtcaccat

SEQ ID NO: 25799 - DNA, 22 bp, Artificial Sequence
  Synthetic Construct
gcaccacatggcagtggaacat

SEQ ID NO: 25800 - DNA, 20 bp, Artificial Sequence
  Synthetic Construct
ccgtggcacccttgaagaga

SEQ ID NO: 25801 - DNA, 18 bp, Artificial Sequence
  Synthetic Construct
tggcactggcaggcatca

SEQ ID NO: 25802 - DNA, 20 bp, Artificial Sequence
  Synthetic Construct
aggggacgtgggctcagaca

SEQ ID NO: 25803 - DNA, 24 bp, Artificial Sequence
  Synthetic Construct
caccaagtcctgcttgtgttttag

SEQ ID NO: 25804 - DNA, 19 bp, Artificial Sequence
  Synthetic Construct
cgccatccctgctcagctt

SEQ ID NO: 25805 - DNA, 19 bp, Artificial Sequence
  Synthetic Construct
tccgggcctgacctcatca

SEQ ID NO: 25806 - DNA, 19 bp, Artificial Sequence
  Synthetic Construct
ggagtctggccccagcttt

SEQ ID NO: 25807 - DNA, 22 bp, Artificial Sequence
  Synthetic Construct
ggctctgccttcacatttctgt

SEQ ID NO: 25808 - DNA, 22 bp, Artificial Sequence
  Synthetic Construct
gtggagcaacatcccagccata

SEQ ID NO: 25809 - DNA, 19 bp, Artificial Sequence
  Synthetic Construct
tccacccggccagagacaa

SEQ ID NO: 25810 - DNA, 21 bp, Artificial Sequence
  Synthetic Construct
tgggccctgtggtcttagtga

SEQ ID NO: 25811 - DNA, 21 bp, Artificial Sequence
  Synthetic Construct
ggcccctttgcctcttaggat

SEQ ID NO: 25812 - DNA, 20 bp, Artificial Sequence
  Synthetic Construct
tggatggcccactgcaggat

SEQ ID NO: 25813 - DNA, 20 bp, Artificial Sequence
  Synthetic Construct
tggtgggcgaggagcttgta

SEQ ID NO: 25814 - DNA, 19 bp, Artificial Sequence
  Synthetic Construct
aggagccccgtacctccat

SEQ ID NO: 25815 - DNA, 20 bp, Artificial Sequence
  Synthetic Construct
agctcagtgacggggctgaa

SEQ ID NO: 25816 - DNA, 20 bp, Artificial Sequence
  Synthetic Construct
gccagagaacgtctcagctt

SEQ ID NO: 25817 - DNA, 20 bp, Artificial Sequence
  Synthetic Construct
cgtcctgccggggaaaacta

SEQ ID NO: 25818 - DNA, 20 bp, Artificial Sequence
  Synthetic Construct
tgtggtgaggtgggagtcaa

SEQ ID NO: 25819 - DNA, 20 bp, Artificial Sequence
  Synthetic Construct
tggacacacaacacccaaca

SEQ ID NO: 25820 - DNA, 23 bp, Artificial Sequence
  Synthetic Construct
gggtaggcattgttccacactct

SEQ ID NO: 25821 - DNA, 23 bp, Artificial Sequence
  Synthetic Construct
ggtcaagtcatcaggtggagtca

SEQ ID NO: 25822 - DNA, 25 bp, Artificial Sequence
  Synthetic Construct
ggaaaacgtatcacctttcccagat

SEQ ID NO: 25823 - DNA, 23 bp, Artificial Sequence
  Synthetic Construct
agtaggctttgcagaagtgaagt

SEQ ID NO: 25824 - DNA, 22 bp, Artificial Sequence
  Synthetic Construct
cacggctcacttgttgactttg

SEQ ID NO: 25825 - DNA, 24 bp, Artificial Sequence
  Synthetic Construct
tgccttggatgatgagttgagaag

SEQ ID NO: 25826 - DNA, 20 bp, Artificial Sequence
  Synthetic Construct
gcctgtttgcgcaggtctga

SEQ ID NO: 25827 - DNA, 22 bp, Artificial Sequence
  Synthetic Construct
gacgtccctgcattcccaatct

SEQ ID NO: 25828 - DNA, 19 bp, Artificial Sequence
  Synthetic Construct
acccacccagcgacaggtt

SEQ ID NO: 25829 - DNA, 24 bp, Artificial Sequence
  Synthetic Construct
gactgatgagtctgggttcacatc

SEQ ID NO: 25830 - DNA, 20 bp, Artificial Sequence
  Synthetic Construct
ggctgccaaccaccactaga

SEQ ID NO: 25831 - DNA, 23 bp, Artificial Sequence
  Synthetic Construct
cacctctcaacactggtctttct

SEQ ID NO: 25832 - DNA, 21 bp, Artificial Sequence
  Synthetic Construct
agagatctgggccagccaaag

SEQ ID NO: 25833 - DNA, 20 bp, Artificial Sequence
  Synthetic Construct
taggcactgcagccctttca

SEQ ID NO: 25834 - DNA, 19 bp, Artificial Sequence
  Synthetic Construct
ttgccacgcaaggctactt

SEQ ID NO: 25835 - DNA, 20 bp, Artificial Sequence
  Synthetic Construct
atggctggctgcccaggtaa

SEQ ID NO: 25836 - DNA, 23 bp, Artificial Sequence
  Synthetic Construct
ctctgctggtaggggtgattgat

SEQ ID NO: 25837 - DNA, 25 bp, Artificial Sequence
  Synthetic Construct
ggttgtcaaatcccaagtccagtct

SEQ ID NO: 25838 - DNA, 26 bp, Artificial Sequence
  Synthetic Construct
gcctttcaaatccagtggtgacaaac

SEQ ID NO: 25839 - DNA, 22 bp, Artificial Sequence
  Synthetic Construct
ggacccagcctacatcacattc

SEQ ID NO: 25840 - DNA, 20 bp, Artificial Sequence
  Synthetic Construct
ttggggacactgtggagcaa

SEQ ID NO: 25841 - DNA, 23 bp, Artificial Sequence
  Synthetic Construct
cctacacaaggagggaagagtga

SEQ ID NO: 25842 - DNA, 24 bp, Artificial Sequence
  Synthetic Construct
gaattcccaggttgaggaaaccta

SEQ ID NO: 25843 - DNA, 19 bp, Artificial Sequence
  Synthetic Construct
aagccccagcccactggat

SEQ ID NO: 25844 - DNA, 22 bp, Artificial Sequence
  Synthetic Construct
gtctacagcacctttccacaca

SEQ ID NO: 25845 - DNA, 21 bp, Artificial Sequence
  Synthetic Construct
tccacccaaggtgccttctta

SEQ ID NO: 25846 - DNA, 20 bp, Artificial Sequence
  Synthetic Construct
gccttcacagccaacactga

SEQ ID NO: 25847 - DNA, 22 bp, Artificial Sequence
  Synthetic Construct
tcctgctaatctggctttcgtt

SEQ ID NO: 25848 - DNA, 24 bp, Artificial Sequence
  Synthetic Construct
cccacaggaactgtccatccaatc

SEQ ID NO: 25849 - DNA, 22 bp, Artificial Sequence
  Synthetic Construct
cctgtccccaggacattgaagt

SEQ ID NO: 25850 - DNA, 22 bp, Artificial Sequence
  Synthetic Construct
cccaaagaaagcccgtgtggtt

SEQ ID NO: 25851 - DNA, 24 bp, Artificial Sequence
  Synthetic Construct
ccaccaccagatgggaaaggtact

SEQ ID NO: 25852 - DNA, 21 bp, Artificial Sequence
  Synthetic Construct
atgtcccctaggcaggcagat

SEQ ID NO: 25853 - DNA, 20 bp, Artificial Sequence
  Synthetic Construct
ctctgcccctggacactgaa

SEQ ID NO: 25854 - DNA, 19 bp, Artificial Sequence
  Synthetic Construct
tttcccacggctgctcact

SEQ ID NO: 25855 - DNA, 26 bp, Artificial Sequence
  Synthetic Construct
cagtacagaaagtcctgtgggaacta

SEQ ID NO: 25856 - DNA, 22 bp, Artificial Sequence
  Synthetic Construct
cagggctcgtagccttgttcta

SEQ ID NO: 25857 - DNA, 23 bp, Artificial Sequence
  Synthetic Construct
agggcagattgctgactttttga

SEQ ID NO: 25858 - DNA, 19 bp, Artificial Sequence
  Synthetic Construct
gctccacactgccgcaaca

SEQ ID NO: 25859 - DNA, 19 bp, Artificial Sequence
  Synthetic Construct
acagccacccttggcaaac

SEQ ID NO: 25860 - DNA, 23 bp, Artificial Sequence
  Synthetic Construct
acaacattgacggctttggtatg

SEQ ID NO: 25861 - DNA, 22 bp, Artificial Sequence
  Synthetic Construct
gccatggtccctcccaagttac

SEQ ID NO: 25862 - DNA, 20 bp, Artificial Sequence
  Synthetic Construct
agactgaccagcccggaaaa

SEQ ID NO: 25863 - DNA, 22 bp, Artificial Sequence
  Synthetic Construct
ccactgcacctggcctgttttt

SEQ ID NO: 25864 - DNA, 21 bp, Artificial Sequence
  Synthetic Construct
gcctctggttcccctttctgt

SEQ ID NO: 25865 - DNA, 20 bp, Artificial Sequence
  Synthetic Construct
ggaacacagccatgcccatt

SEQ ID NO: 25866 - DNA, 20 bp, Artificial Sequence
  Synthetic Construct
gctgcccagcgttcaatatc

SEQ ID NO: 25867 - DNA, 24 bp, Artificial Sequence
  Synthetic Construct
cggaaggcatagggtaagcactga

SEQ ID NO: 25868 - DNA, 22 bp, Artificial Sequence
  Synthetic Construct
cagggatcaagctgtggcttag

SEQ ID NO: 25869 - DNA, 22 bp, Artificial Sequence
  Synthetic Construct
agggaggcagtagtaggtttga

SEQ ID NO: 25870 - DNA, 20 bp, Artificial Sequence
  Synthetic Construct
aagggctttccccgcttttg

SEQ ID NO: 25871 - DNA, 22 bp, Artificial Sequence
  Synthetic Construct
tccccgctacccaggagtctaa

SEQ ID NO: 25872 - DNA, 24 bp, Artificial Sequence
  Synthetic Construct
ggtaatttctgggctgacaaggtt

SEQ ID NO: 25873 - DNA, 22 bp, Artificial Sequence
  Synthetic Construct
ccacagggcattgcaggtttac

SEQ ID NO: 25874 - DNA, 20 bp, Artificial Sequence
  Synthetic Construct
cccctgcccagtttccaaat

SEQ ID NO: 25875 - DNA, 26 bp, Artificial Sequence
  Synthetic Construct
gcaactttgactcacctcactgacaa

SEQ ID NO: 25876 - DNA, 25 bp, Artificial Sequence
  Synthetic Construct
cgatgaggacacttcctctttctga

SEQ ID NO: 25877 - DNA, 20 bp, Artificial Sequence
  Synthetic Construct
gggtcctgcagacaaacctt

SEQ ID NO: 25878 - DNA, 30 bp, Artificial Sequence
  Synthetic Construct
ctcccaactgagatttgcgatataatcttc

SEQ ID NO: 25879 - DNA, 20 bp, Artificial Sequence
  Synthetic Construct
cacctgtggtcccagcaact

SEQ ID NO: 25880 - DNA, 22 bp, Artificial Sequence
  Synthetic Construct
ccacctccaggcctaagaaatc

SEQ ID NO: 25881 - DNA, 22 bp, Artificial Sequence
  Synthetic Construct
acttcctccctggtcctgatgt

SEQ ID NO: 25882 - DNA, 22 bp, Artificial Sequence
  Synthetic Construct
cacccatgctccttccatcaga

SEQ ID NO: 25883 - DNA, 24 bp, Artificial Sequence
  Synthetic Construct
gctgaaagctgtggtttggttttg

SEQ ID NO: 25884 - DNA, 22 bp, Artificial Sequence
  Synthetic Construct
agccccagttccccacaactaa

SEQ ID NO: 25885 - DNA, 23 bp, Artificial Sequence
  Synthetic Construct
tgctgttggaactggaaagagtt

SEQ ID NO: 25886 - DNA, 19 bp, Artificial Sequence
  Synthetic Construct
ccatccccgctccaactca

SEQ ID NO: 25887 - DNA, 24 bp, Artificial Sequence
  Synthetic Construct
ccctctggaagcttgtgtctagtt

SEQ ID NO: 25888 - DNA, 23 bp, Artificial Sequence
  Synthetic Construct
tgtatctgcggctgaattgagaa

SEQ ID NO: 25889 - DNA, 22 bp, Artificial Sequence
  Synthetic Construct
ggtttggtctgtggctgcatag

SEQ ID NO: 25890 - DNA, 24 bp, Artificial Sequence
  Synthetic Construct
cagttaaagtccgaggaggtgatg

SEQ ID NO: 25891 - DNA, 20 bp, Artificial Sequence
  Synthetic Construct
gcaactgagcatcggagact

SEQ ID NO: 25892 - DNA, 25 bp, Artificial Sequence
  Synthetic Construct
ccttcagcaactgtagctcctctac

SEQ ID NO: 25893 - DNA, 23 bp, Artificial Sequence
  Synthetic Construct
cggttgcctctctctttactgat

SEQ ID NO: 25894 - DNA, 19 bp, Artificial Sequence
  Synthetic Construct
ggtgcgaggaggggtttgt

SEQ ID NO: 25895 - DNA, 20 bp, Artificial Sequence
  Synthetic Construct
gaagttccccgttgcacaga

SEQ ID NO: 25896 - DNA, 20 bp, Artificial Sequence
  Synthetic Construct
gcttgccagccaacctgtta

SEQ ID NO: 25897 - DNA, 22 bp, Artificial Sequence
  Synthetic Construct
ccagttggtccatgggcagtta

SEQ ID NO: 25898 - DNA, 22 bp, Artificial Sequence
  Synthetic Construct
gggtgggccattaagacagttc

SEQ ID NO: 25899 - DNA, 24 bp, Artificial Sequence
  Synthetic Construct
ggaggagagaagccttgggatttg

SEQ ID NO: 25900 - DNA, 25 bp, Artificial Sequence
  Synthetic Construct
ccaggaagctgcaatatggaagtga

SEQ ID NO: 25901 - DNA, 20 bp, Artificial Sequence
  Synthetic Construct
gccgtggctgtccaaatgtt

SEQ ID NO: 25902 - DNA, 22 bp, Artificial Sequence
  Synthetic Construct
tgagttctgtgagtccgtgaag

SEQ ID NO: 25903 - DNA, 22 bp, Artificial Sequence
  Synthetic Construct
aacaccatcgtccgtcatgatt

SEQ ID NO: 25904 - DNA, 25 bp, Artificial Sequence
  Synthetic Construct
cccacatccaggatacttggctttt

SEQ ID NO: 25905 - DNA, 20 bp, Artificial Sequence
  Synthetic Construct
tccgacccttctcccacatt

SEQ ID NO: 25906 - DNA, 19 bp, Artificial Sequence
  Synthetic Construct
gtctgcgtggagggagaga

SEQ ID NO: 25907 - DNA, 20 bp, Artificial Sequence
  Synthetic Construct
tcccgtctcccatcacacat

SEQ ID NO: 25908 - DNA, 22 bp, Artificial Sequence
  Synthetic Construct
ggttacattgccggtgatcaag

SEQ ID NO: 25909 - DNA, 20 bp, Artificial Sequence
  Synthetic Construct
ccgcttggctctcattctct

SEQ ID NO: 25910 - DNA, 19 bp, Artificial Sequence
  Synthetic Construct
gagcctggggagaggatca

SEQ ID NO: 25911 - DNA, 26 bp, Artificial Sequence
  Synthetic Construct
gtatgtgaagatggttgcttggaatc

SEQ ID NO: 25912 - DNA, 25 bp, Artificial Sequence
  Synthetic Construct
cccaaagcactagagactgggtcat

SEQ ID NO: 25913 - DNA, 21 bp, Artificial Sequence
  Synthetic Construct
aggcctgggttgccttgtaac

SEQ ID NO: 25914 - DNA, 20 bp, Artificial Sequence
  Synthetic Construct
ggccaagcaaggtggaatct

SEQ ID NO: 25915 - DNA, 22 bp, Artificial Sequence
  Synthetic Construct
tgtggacagcagcgtctctaag

SEQ ID NO: 25916 - DNA, 27 bp, Artificial Sequence
  Synthetic Construct
ggtcatgaacatggaaggaacaagatt

SEQ ID NO: 25917 - DNA, 22 bp, Artificial Sequence
  Synthetic Construct
ctgaagtccaacaggcatctca

SEQ ID NO: 25918 - DNA, 26 bp, Artificial Sequence
  Synthetic Construct
gacttcctttctaccttgttgctgat

SEQ ID NO: 25919 - DNA, 25 bp, Artificial Sequence
  Synthetic Construct
caccatgaagttcagtccatagtca

SEQ ID NO: 25920 - DNA, 20 bp, Artificial Sequence
  Synthetic Construct
cccaccgtcctgcatactca

SEQ ID NO: 25921 - DNA, 24 bp, Artificial Sequence
  Synthetic Construct
acgtaagtgaatgaggggagaact

SEQ ID NO: 25922 - DNA, 22 bp, Artificial Sequence
  Synthetic Construct
tcactgcaccattttccccaat

SEQ ID NO: 25923 - DNA, 22 bp, Artificial Sequence
  Synthetic Construct
tcctcagggccttgggaaacat

SEQ ID NO: 25924 - DNA, 23 bp, Artificial Sequence
  Synthetic Construct
agcctgcctcacattatcctttc

SEQ ID NO: 25925 - DNA, 21 bp, Artificial Sequence
  Synthetic Construct
ggcagggaggtcctgactgaa

SEQ ID NO: 25926 - DNA, 25 bp, Artificial Sequence
  Synthetic Construct
ctgggacaggaccaaatccaactac

SEQ ID NO: 25927 - DNA, 25 bp, Artificial Sequence
  Synthetic Construct
gctaactctgacaggctaagtgcta

SEQ ID NO: 25928 - DNA, 24 bp, Artificial Sequence
  Synthetic Construct
actggaaacccatgaagactccta

SEQ ID NO: 25929 - DNA, 20 bp, Artificial Sequence
  Synthetic Construct
gccagatggtgcttggttca

SEQ ID NO: 25930 - DNA, 23 bp, Artificial Sequence
  Synthetic Construct
gggcaatgcctgagaaaatggta

SEQ ID NO: 25931 - DNA, 22 bp, Artificial Sequence
  Synthetic Construct
tccaactggcctttttggaaca

SEQ ID NO: 25932 - DNA, 22 bp, Artificial Sequence
  Synthetic Construct
tcagaggcatgttaccctctct

SEQ ID NO: 25933 - DNA, 23 bp, Artificial Sequence
  Synthetic Construct
gatggcacagagagatgctgaga

SEQ ID NO: 25934 - DNA, 22 bp, Artificial Sequence
  Synthetic Construct
gggccttttggccacagactaa

SEQ ID NO: 25935 - DNA, 23 bp, Artificial Sequence
  Synthetic Construct
aggttctgtcccatacggttttg

SEQ ID NO: 25936 - DNA, 22 bp, Artificial Sequence
  Synthetic Construct
cgctcagcagcagctgtaacta

SEQ ID NO: 25937 - DNA, 19 bp, Artificial Sequence
  Synthetic Construct
agctgcaggttgcagttca

SEQ ID NO: 25938 - DNA, 24 bp, Artificial Sequence
  Synthetic Construct
acgcatccttagtaccttatgcaa

SEQ ID NO: 25939 - DNA, 26 bp, Artificial Sequence
  Synthetic Construct
gtaaggtacggtcagtagtgtagaag

SEQ ID NO: 25940 - DNA, 21 bp, Artificial Sequence
  Synthetic Construct
tcagaggcccttggctgatct

SEQ ID NO: 25941 - DNA, 22 bp, Artificial Sequence
  Synthetic Construct
tccttctgcctgagaaaagcaa

SEQ ID NO: 25942 - DNA, 23 bp, Artificial Sequence
  Synthetic Construct
agagccctagggagctcatggta

SEQ ID NO: 25943 - DNA, 21 bp, Artificial Sequence
  Synthetic Construct
tcactgatccagaccccaaga

SEQ ID NO: 25944 - DNA, 20 bp, Artificial Sequence
  Synthetic Construct
tgccagtccaaccagcatag

SEQ ID NO: 25945 - DNA, 20 bp, Artificial Sequence
  Synthetic Construct
cccagtgggcagaactttga

SEQ ID NO: 25946 - DNA, 23 bp, Artificial Sequence
  Synthetic Construct
gggctcaagtgatcctcccatct

SEQ ID NO: 25947 - DNA, 25 bp, Artificial Sequence
  Synthetic Construct
tgccctagagcaaagggtatatttc

SEQ ID NO: 25948 - DNA, 20 bp, Artificial Sequence
  Synthetic Construct
gttccaggcaacaggagtga

SEQ ID NO: 25949 - DNA, 21 bp, Artificial Sequence
  Synthetic Construct
tctgctgctccctgctccatt

SEQ ID NO: 25950 - DNA, 23 bp, Artificial Sequence
  Synthetic Construct
gggcactttgcccgtgtaattct

SEQ ID NO: 25951 - DNA, 21 bp, Artificial Sequence
  Synthetic Construct
gccactagcctccatgtcaag

SEQ ID NO: 25952 - DNA, 21 bp, Artificial Sequence
  Synthetic Construct
ctgtgggcacaggaatcatct

SEQ ID NO: 25953 - DNA, 22 bp, Artificial Sequence
  Synthetic Construct
aggacaggaggcaggttcaagt

SEQ ID NO: 25954 - DNA, 22 bp, Artificial Sequence
  Synthetic Construct
cctctgtgtgttgtgcttggaa

SEQ ID NO: 25955 - DNA, 20 bp, Artificial Sequence
  Synthetic Construct
gccaagctccgtgctggtaa

SEQ ID NO: 25956 - DNA, 24 bp, Artificial Sequence
  Synthetic Construct
caaaccgaagcagacatagtgaag

SEQ ID NO: 25957 - DNA, 23 bp, Artificial Sequence
  Synthetic Construct
gcaagattgtgtctggaggttca

SEQ ID NO: 25958 - DNA, 23 bp, Artificial Sequence
  Synthetic Construct
cggtgaggctttggagagttttg

SEQ ID NO: 25959 - DNA, 20 bp, Artificial Sequence
  Synthetic Construct
tcctgccttgggacatggaa

SEQ ID NO: 25960 - DNA, 19 bp, Artificial Sequence
  Synthetic Construct
acagcggggcattcacaga

SEQ ID NO: 25961 - DNA, 22 bp, Artificial Sequence
  Synthetic Construct
gatggagagcatctgggtcctt

SEQ ID NO: 25962 - DNA, 22 bp, Artificial Sequence
  Synthetic Construct
tgggtccacactggtggaatga

SEQ ID NO: 25963 - DNA, 22 bp, Artificial Sequence
  Synthetic Construct
tcttggggtggattggggactt

SEQ ID NO: 25964 - DNA, 23 bp, Artificial Sequence
  Synthetic Construct
acagtcaagcaaggggtgttatg

SEQ ID NO: 25965 - DNA, 22 bp, Artificial Sequence
  Synthetic Construct
ctgcccactgtcactactgcat

SEQ ID NO: 25966 - DNA, 25 bp, Artificial Sequence
  Synthetic Construct
caggatggagtcacaccgataactt

SEQ ID NO: 25967 - DNA, 20 bp, Artificial Sequence
  Synthetic Construct
ccagccaccacagtccatca

SEQ ID NO: 25968 - DNA, 22 bp, Artificial Sequence
  Synthetic Construct
ccttccggaggcaaaggaaaca

SEQ ID NO: 25969 - DNA, 23 bp, Artificial Sequence
  Synthetic Construct
gtcttgacaagtggctcgcagtt

SEQ ID NO: 25970 - DNA, 25 bp, Artificial Sequence
  Synthetic Construct
gcattgccccgtaatacctatcttg

SEQ ID NO: 25971 - DNA, 24 bp, Artificial Sequence
  Synthetic Construct
ggctttgcatgttggtgggatact

SEQ ID NO: 25972 - DNA, 22 bp, Artificial Sequence
  Synthetic Construct
catgtaatgcctgctccctttg

SEQ ID NO: 25973 - DNA, 22 bp, Artificial Sequence
  Synthetic Construct
gatttgcttggccctggtaagt

SEQ ID NO: 25974 - DNA, 21 bp, Artificial Sequence
  Synthetic Construct
ggagctgaatgctgcctggat

SEQ ID NO: 25975 - DNA, 24 bp, Artificial Sequence
  Synthetic Construct
ggtggtactgatgctttggtctga

SEQ ID NO: 25976 - DNA, 21 bp, Artificial Sequence
  Synthetic Construct
ccctgtagctttgggctcctt

SEQ ID NO: 25977 - DNA, 21 bp, Artificial Sequence
  Synthetic Construct
ccccatggtctcaggctcaag

SEQ ID NO: 25978 - DNA, 19 bp, Artificial Sequence
  Synthetic Construct
cgcggacacccttggaaca

SEQ ID NO: 25979 - DNA, 22 bp, Artificial Sequence
  Synthetic Construct
gagccagtccaatggtctcctt

SEQ ID NO: 25980 - DNA, 20 bp, Artificial Sequence
  Synthetic Construct
cagcaccgacagcaacgaaa

SEQ ID NO: 25981 - DNA, 22 bp, Artificial Sequence
  Synthetic Construct
cggttctgaaacagggagtctt

SEQ ID NO: 25982 - DNA, 20 bp, Artificial Sequence
  Synthetic Construct
tgctgtggtcccagctactt

SEQ ID NO: 25983 - DNA, 25 bp, Artificial Sequence
  Synthetic Construct
tgtcagcagaaaatgtacagtgcta

SEQ ID NO: 25984 - DNA, 21 bp, Artificial Sequence
  Synthetic Construct
tggccacctgtccatctccaa

SEQ ID NO: 25985 - DNA, 22 bp, Artificial Sequence
  Synthetic Construct
gcctctggccagccttcaaaat

SEQ ID NO: 25986 - DNA, 23 bp, Artificial Sequence
  Synthetic Construct
gggcacagaaactcactgttcaa

SEQ ID NO: 25987 - DNA, 22 bp, Artificial Sequence
  Synthetic Construct
tgagcctggtcctcagacaagt

SEQ ID NO: 25988 - DNA, 22 bp, Artificial Sequence
  Synthetic Construct
caatgagcttcccgtcccactt

SEQ ID NO: 25989 - DNA, 22 bp, Artificial Sequence
  Synthetic Construct
ccaggccagggctgttaggata

SEQ ID NO: 25990 - DNA, 23 bp, Artificial Sequence
  Synthetic Construct
gagcccagtaagaagtggagaca

SEQ ID NO: 25991 - DNA, 23 bp, Artificial Sequence
  Synthetic Construct
cagagcggaagaagagtgaagtt

SEQ ID NO: 25992 - DNA, 30 bp, Artificial Sequence
  Synthetic Construct
ggtggcaaagcagattcatttttctcctaa

SEQ ID NO: 25993 - DNA, 23 bp, Artificial Sequence
  Synthetic Construct
accatgaggaagaattggccttt

SEQ ID NO: 25994 - DNA, 21 bp, Artificial Sequence
  Synthetic Construct
gcatagcatcctgctccagtt

SEQ ID NO: 25995 - DNA, 23 bp, Artificial Sequence
  Synthetic Construct
ggactagggagccatgtggaagt

SEQ ID NO: 25996 - DNA, 24 bp, Artificial Sequence
  Synthetic Construct
tccagtctcattttgcactgttct

SEQ ID NO: 25997 - DNA, 25 bp, Artificial Sequence
  Synthetic Construct
gcttccctggttggtaatactctgt

SEQ ID NO: 25998 - DNA, 20 bp, Artificial Sequence
  Synthetic Construct
gtagcggttgctgcttgatg

SEQ ID NO: 25999 - DNA, 22 bp, Artificial Sequence
  Synthetic Construct
ccaacgtaggtctggactgatg

SEQ ID NO: 26000 - DNA, 20 bp, Artificial Sequence
  Synthetic Construct
tgatgcgaacatggctcact

SEQ ID NO: 26001 - DNA, 22 bp, Artificial Sequence
  Synthetic Construct
ctggggcagagcaagtggaaaa

SEQ ID NO: 26002 - DNA, 23 bp, Artificial Sequence
  Synthetic Construct
ggctcctaaccactaagaacaca

SEQ ID NO: 26003 - DNA, 23 bp, Artificial Sequence
  Synthetic Construct
gggaggggacaagaactgtgaga

SEQ ID NO: 26004 - DNA, 26 bp, Artificial Sequence
  Synthetic Construct
gtttgagatggtgctactgacttaac

SEQ ID NO: 26005 - DNA, 19 bp, Artificial Sequence
  Synthetic Construct
tgctcccagagtgctcaca

SEQ ID NO: 26006 - DNA, 22 bp, Artificial Sequence
  Synthetic Construct
cccaaggaacacagaccctagt

SEQ ID NO: 26007 - DNA, 20 bp, Artificial Sequence
  Synthetic Construct
gcccggctgaaagcaaccat

SEQ ID NO: 26008 - DNA, 22 bp, Artificial Sequence
  Synthetic Construct
cttttctgcatgtggcttccaa

SEQ ID NO: 26009 - DNA, 22 bp, Artificial Sequence
  Synthetic Construct
agagaccgactgggaggataga

SEQ ID NO: 26010 - DNA, 24 bp, Artificial Sequence
  Synthetic Construct
gagctgctgagatgctcctctttc

SEQ ID NO: 26011 - DNA, 20 bp, Artificial Sequence
  Synthetic Construct
cacgctccagcaacaagaag

SEQ ID NO: 26012 - DNA, 23 bp, Artificial Sequence
  Synthetic Construct
gactggtttcatctcacctgtgt

SEQ ID NO: 26013 - DNA, 22 bp, Artificial Sequence
  Synthetic Construct
caccactgactcacccttgaat

SEQ ID NO: 26014 - DNA, 22 bp, Artificial Sequence
  Synthetic Construct
cccctcgggtctcaaggatttt

SEQ ID NO: 26015 - DNA, 19 bp, Artificial Sequence
  Synthetic Construct
tcgagccaggaaggcaagt

SEQ ID NO: 26016 - DNA, 22 bp, Artificial Sequence
  Synthetic Construct
ctcaaagccatatcgggagcat

SEQ ID NO: 26017 - DNA, 21 bp, Artificial Sequence
  Synthetic Construct
agctctgggttgaccgtggaa

SEQ ID NO: 26018 - DNA, 24 bp, Artificial Sequence
  Synthetic Construct
cactgccaaccaagatccttatgt

SEQ ID NO: 26019 - DNA, 24 bp, Artificial Sequence
  Synthetic Construct
ctgatccataggccgaagtgacaa

SEQ ID NO: 26020 - DNA, 20 bp, Artificial Sequence
  Synthetic Construct
gctgtggtcacgctgtgaaa

SEQ ID NO: 26021 - DNA, 22 bp, Artificial Sequence
  Synthetic Construct
tcacaggcttgggaatgtcaat

SEQ ID NO: 26022 - DNA, 22 bp, Artificial Sequence
  Synthetic Construct
cccacttttgaccctggcctta

SEQ ID NO: 26023 - DNA, 22 bp, Artificial Sequence
  Synthetic Construct
ggcctgagcaggtgttttagta

SEQ ID NO: 26024 - DNA, 22 bp, Artificial Sequence
  Synthetic Construct
cttgccaagctggcatctaagt

SEQ ID NO: 26025 - DNA, 21 bp, Artificial Sequence
  Synthetic Construct
cagtgactgcccaatgtggta

SEQ ID NO: 26026 - DNA, 25 bp, Artificial Sequence
  Synthetic Construct
gcactggtcaacctaggagtgctaa

SEQ ID NO: 26027 - DNA, 18 bp, Artificial Sequence
  Synthetic Construct
tcagcagcctcccacact

SEQ ID NO: 26028 - DNA, 21 bp, Artificial Sequence
  Synthetic Construct
gcacctgcatccagcgataag

SEQ ID NO: 26029 - DNA, 26 bp, Artificial Sequence
  Synthetic Construct
caagatgttccaaggtagaagagaga

SEQ ID NO: 26030 - DNA, 24 bp, Artificial Sequence
  Synthetic Construct
ggtaagtttgctcccctactcact

SEQ ID NO: 26031 - DNA, 23 bp, Artificial Sequence
  Synthetic Construct
gaggctctggaagaccattcctt

SEQ ID NO: 26032 - DNA, 20 bp, Artificial Sequence
  Synthetic Construct
ggtccctgagccagggctat

SEQ ID NO: 26033 - DNA, 20 bp, Artificial Sequence
  Synthetic Construct
gggctttggaccttcagcat

SEQ ID NO: 26034 - DNA, 20 bp, Artificial Sequence
  Synthetic Construct
aggatggggctcggaaaaac

SEQ ID NO: 26035 - DNA, 24 bp, Artificial Sequence
  Synthetic Construct
ccgtgcccggcatattattttagt

SEQ ID NO: 26036 - DNA, 21 bp, Artificial Sequence
  Synthetic Construct
cctctctgtggaggggattct

SEQ ID NO: 26037 - DNA, 20 bp, Artificial Sequence
  Synthetic Construct
ggttgcttctgcacctggat

SEQ ID NO: 26038 - DNA, 25 bp, Artificial Sequence
  Synthetic Construct
gcctttagtttgggccagaagaact

SEQ ID NO: 26039 - DNA, 21 bp, Artificial Sequence
  Synthetic Construct
cggccttggctcctgtagttt

SEQ ID NO: 26040 - DNA, 25 bp, Artificial Sequence
  Synthetic Construct
ccatgatccctgtaaacagctcaga

SEQ ID NO: 26041 - DNA, 23 bp, Artificial Sequence
  Synthetic Construct
cacacactgagactgaggaaaga

SEQ ID NO: 26042 - DNA, 21 bp, Artificial Sequence
  Synthetic Construct
cgaccaagggccttcaaggaa

SEQ ID NO: 26043 - DNA, 25 bp, Artificial Sequence
  Synthetic Construct
tgacacaaactgagaacaaccaatc

SEQ ID NO: 26044 - DNA, 19 bp, Artificial Sequence
  Synthetic Construct
tgtgcctgccagccaagtt

SEQ ID NO: 26045 - DNA, 24 bp, Artificial Sequence
  Synthetic Construct
gaccttcgctctattccctctcaa

SEQ ID NO: 26046 - DNA, 24 bp, Artificial Sequence
  Synthetic Construct
gtcaatttgctctgggagatggaa

SEQ ID NO: 26047 - DNA, 19 bp, Artificial Sequence
  Synthetic Construct
aaccagcgaggcacccatt

SEQ ID NO: 26048 - DNA, 18 bp, Artificial Sequence
  Synthetic Construct
tgcctccttggccagttg

SEQ ID NO: 26049 - DNA, 21 bp, Artificial Sequence
  Synthetic Construct
ggcagaggaggcagggagtta

SEQ ID NO: 26050 - DNA, 23 bp, Artificial Sequence
  Synthetic Construct
gcagctctacagagaggcagaca

SEQ ID NO: 26051 - DNA, 25 bp, Artificial Sequence
  Synthetic Construct
ttccaaagccataacaacgagtaac

SEQ ID NO: 26052 - DNA, 24 bp, Artificial Sequence
  Synthetic Construct
gtcttccagagcattcatcgttca

SEQ ID NO: 26053 - DNA, 23 bp, Artificial Sequence
  Synthetic Construct
gtcctcctgtggttccagacttc

SEQ ID NO: 26054 - DNA, 20 bp, Artificial Sequence
  Synthetic Construct
gatgtgctgggagtcagctt

SEQ ID NO: 26055 - DNA, 19 bp, Artificial Sequence
  Synthetic Construct
agctggaccaggccattca

SEQ ID NO: 26056 - DNA, 19 bp, Artificial Sequence
  Synthetic Construct
tggcccttccttgccctta

SEQ ID NO: 26057 - DNA, 24 bp, Artificial Sequence
  Synthetic Construct
agttggtcatctgtcaatctgcat

SEQ ID NO: 26058 - DNA, 28 bp, Artificial Sequence
  Synthetic Construct
ccattcttggcctatgtctgctctttag

SEQ ID NO: 26059 - DNA, 21 bp, Artificial Sequence
  Synthetic Construct
gatagggcccagaggggtatc

SEQ ID NO: 26060 - DNA, 23 bp, Artificial Sequence
  Synthetic Construct
gtgcacaggtgggcattattaag

SEQ ID NO: 26061 - DNA, 23 bp, Artificial Sequence
  Synthetic Construct
gggcatgtgaaacatcacttgtt

SEQ ID NO: 26062 - DNA, 23 bp, Artificial Sequence
  Synthetic Construct
ccaagccaagctttcaagacaca

SEQ ID NO: 26063 - DNA, 23 bp, Artificial Sequence
  Synthetic Construct
gctaggccacaggagtcacagat

SEQ ID NO: 26064 - DNA, 19 bp, Artificial Sequence
  Synthetic Construct
gcccctgcgtcttggagtt

SEQ ID NO: 26065 - DNA, 20 bp, Artificial Sequence
  Synthetic Construct
ctttcacccagcaccacgta

SEQ ID NO: 26066 - DNA, 23 bp, Artificial Sequence
  Synthetic Construct
cggctcggaaccgttttatttac

SEQ ID NO: 26067 - DNA, 22 bp, Artificial Sequence
  Synthetic Construct
tgctggatgagggtgccttttg

SEQ ID NO: 26068 - DNA, 24 bp, Artificial Sequence
  Synthetic Construct
caagcgtctgggataagtgaacaa

SEQ ID NO: 26069 - DNA, 22 bp, Artificial Sequence
  Synthetic Construct
tgcatctccctacctggcatga

SEQ ID NO: 26070 - DNA, 20 bp, Artificial Sequence
  Synthetic Construct
agcagccaagggcttctgat

SEQ ID NO: 26071 - DNA, 20 bp, Artificial Sequence
  Synthetic Construct
ggctccccaagcactagaca

SEQ ID NO: 26072 - DNA, 21 bp, Artificial Sequence
  Synthetic Construct
agtggggctgattccaacaag

SEQ ID NO: 26073 - DNA, 19 bp, Artificial Sequence
  Synthetic Construct
tcagcagcaggccatgaac

SEQ ID NO: 26074 - DNA, 22 bp, Artificial Sequence
  Synthetic Construct
agttaggagtaggccggtgtct

SEQ ID NO: 26075 - DNA, 18 bp, Artificial Sequence
  Synthetic Construct
gccctgggccgaacattt

SEQ ID NO: 26076 - DNA, 24 bp, Artificial Sequence
  Synthetic Construct
gggaacgtgttctgccattctgat

SEQ ID NO: 26077 - DNA, 23 bp, Artificial Sequence
  Synthetic Construct
aagacagaaagtccgttggaact

SEQ ID NO: 26078 - DNA, 24 bp, Artificial Sequence
  Synthetic Construct
gccttcagccccaggaatgaaatg

SEQ ID NO: 26079 - DNA, 20 bp, Artificial Sequence
  Synthetic Construct
gggctctgccctttcagcta

SEQ ID NO: 26080 - DNA, 20 bp, Artificial Sequence
  Synthetic Construct
tgcagcaagaactgccacat

SEQ ID NO: 26081 - DNA, 23 bp, Artificial Sequence
  Synthetic Construct
cctgggaacagtgatacttgcat

SEQ ID NO: 26082 - DNA, 20 bp, Artificial Sequence
  Synthetic Construct
aagggaacatgggcgtgatt

SEQ ID NO: 26083 - DNA, 23 bp, Artificial Sequence
  Synthetic Construct
agaatcggagactcactggttga

SEQ ID NO: 26084 - DNA, 23 bp, Artificial Sequence
  Synthetic Construct
ttatgacacacctccgtgtgatt

SEQ ID NO: 26085 - DNA, 20 bp, Artificial Sequence
  Synthetic Construct
ggcctgcctttccactcaat

SEQ ID NO: 26086 - DNA, 22 bp, Artificial Sequence
  Synthetic Construct
gcaagccatccaccctcactaa

SEQ ID NO: 26087 - DNA, 22 bp, Artificial Sequence
  Synthetic Construct
acctgacccctcatgggacttt

SEQ ID NO: 26088 - DNA, 23 bp, Artificial Sequence
  Synthetic Construct
acgttgtccctacactgacattt

SEQ ID NO: 26089 - DNA, 21 bp, Artificial Sequence
  Synthetic Construct
ccacacacgctgtgcagaaag

SEQ ID NO: 26090 - DNA, 25 bp, Artificial Sequence
  Synthetic Construct
ggagattcgggtgtctgatgcctaa

SEQ ID NO: 26091 - DNA, 19 bp, Artificial Sequence
  Synthetic Construct
acctcaggtgtcccgtgtt

SEQ ID NO: 26092 - DNA, 20 bp, Artificial Sequence
  Synthetic Construct
ggccccaggtctctcagctt

SEQ ID NO: 26093 - DNA, 26 bp, Artificial Sequence
  Synthetic Construct
tgagtaagtgggtctttccttaggtt

SEQ ID NO: 26094 - DNA, 20 bp, Artificial Sequence
  Synthetic Construct
cagcagctcccagtgacttc

SEQ ID NO: 26095 - DNA, 21 bp, Artificial Sequence
  Synthetic Construct
cccctgcatgacctctccatt

SEQ ID NO: 26096 - DNA, 23 bp, Artificial Sequence
  Synthetic Construct
cacgtccccacccttcttgtatg

SEQ ID NO: 26097 - DNA, 21 bp, Artificial Sequence
  Synthetic Construct
tttgggtgctggacccctttg

SEQ ID NO: 26098 - DNA, 23 bp, Artificial Sequence
  Synthetic Construct
ccagatggactggtgaggatttc

SEQ ID NO: 26099 - DNA, 26 bp, Artificial Sequence
  Synthetic Construct
ccttgtatcagagcctctcagtatct

SEQ ID NO: 26100 - DNA, 23 bp, Artificial Sequence
  Synthetic Construct
caccacaaaactacaccgcttga

SEQ ID NO: 26101 - DNA, 20 bp, Artificial Sequence
  Synthetic Construct
tgggccaaggggcaaaaact

SEQ ID NO: 26102 - DNA, 19 bp, Artificial Sequence
  Synthetic Construct
agcagccccaaacctcact

SEQ ID NO: 26103 - DNA, 24 bp, Artificial Sequence
  Synthetic Construct
gacttagaggcccttgggtgtaac

SEQ ID NO: 26104 - DNA, 21 bp, Artificial Sequence
  Synthetic Construct
caccacaccctggcagacatt

SEQ ID NO: 26105 - DNA, 21 bp, Artificial Sequence
  Synthetic Construct
aaagggcaggcagctgaggta

SEQ ID NO: 26106 - DNA, 18 bp, Artificial Sequence
  Synthetic Construct
agtggctggcctgcatgt

SEQ ID NO: 26107 - DNA, 24 bp, Artificial Sequence
  Synthetic Construct
gggaaaaagtccccaaacctgttc

SEQ ID NO: 26108 - DNA, 20 bp, Artificial Sequence
  Synthetic Construct
caggtgtggcctgtgtgagt

SEQ ID NO: 26109 - DNA, 23 bp, Artificial Sequence
  Synthetic Construct
gacaactccctgcttggagtaac

SEQ ID NO: 26110 - DNA, 21 bp, Artificial Sequence
  Synthetic Construct
cctgggtggtctggagaggaa

SEQ ID NO: 26111 - DNA, 21 bp, Artificial Sequence
  Synthetic Construct
atgacccacctctggcaccta

SEQ ID NO: 26112 - DNA, 22 bp, Artificial Sequence
  Synthetic Construct
acacaccccaggtcacttcaga

SEQ ID NO: 26113 - DNA, 21 bp, Artificial Sequence
  Synthetic Construct
tcccacatagagcgggcatca

SEQ ID NO: 26114 - DNA, 24 bp, Artificial Sequence
  Synthetic Construct
ctgcctgacagccattcattcctt

SEQ ID NO: 26115 - DNA, 19 bp, Artificial Sequence
  Synthetic Construct
agcttgccctggggctttg

SEQ ID NO: 26116 - DNA, 20 bp, Artificial Sequence
  Synthetic Construct
tgtgggcatttgggcacctt

SEQ ID NO: 26117 - DNA, 20 bp, Artificial Sequence
  Synthetic Construct
cagggtgtggggcattgtga

SEQ ID NO: 26118 - DNA, 19 bp, Artificial Sequence
  Synthetic Construct
cggggagtgtgggatggaa

SEQ ID NO: 26119 - DNA, 19 bp, Artificial Sequence
  Synthetic Construct
agcacgcaggaggccaaga

SEQ ID NO: 26120 - DNA, 20 bp, Artificial Sequence
  Synthetic Construct
agcactaaccgccagtgatg

SEQ ID NO: 26121 - DNA, 21 bp, Artificial Sequence
  Synthetic Construct
attgatcccctctcccaccat

SEQ ID NO: 26122 - DNA, 22 bp, Artificial Sequence
  Synthetic Construct
cttccttgacgggtcccttttc

SEQ ID NO: 26123 - DNA, 21 bp, Artificial Sequence
  Synthetic Construct
cccctgccaggtgttgaattt

SEQ ID NO: 26124 - DNA, 21 bp, Artificial Sequence
  Synthetic Construct
cactgaggctgtcaggatgtt

SEQ ID NO: 26125 - DNA, 21 bp, Artificial Sequence
  Synthetic Construct
ggggaagagtgaggagactga

SEQ ID NO: 26126 - DNA, 21 bp, Artificial Sequence
  Synthetic Construct
agaggggcacctgttggaaga

SEQ ID NO: 26127 - DNA, 21 bp, Artificial Sequence
  Synthetic Construct
caacaatggcaaggcctgatg

SEQ ID NO: 26128 - DNA, 22 bp, Artificial Sequence
  Synthetic Construct
ggggtggaatgcacacaaggtt

SEQ ID NO: 26129 - DNA, 27 bp, Artificial Sequence
  Synthetic Construct
ctggatctagaaggcagagatacatga

SEQ ID NO: 26130 - DNA, 23 bp, Artificial Sequence
  Synthetic Construct
cctcagctgctcctgtggtctaa

SEQ ID NO: 26131 - DNA, 19 bp, Artificial Sequence
  Synthetic Construct
gcacacaaaggccccaaga

SEQ ID NO: 26132 - DNA, 20 bp, Artificial Sequence
  Synthetic Construct
aggacagcctccagccaata

SEQ ID NO: 26133 - DNA, 22 bp, Artificial Sequence
  Synthetic Construct
gcagcacctgagagaagacact

SEQ ID NO: 26134 - DNA, 22 bp, Artificial Sequence
  Synthetic Construct
caaccaggaccacagaccttca

SEQ ID NO: 26135 - DNA, 21 bp, Artificial Sequence
  Synthetic Construct
cgaattggctgcagcatggtt

SEQ ID NO: 26136 - DNA, 20 bp, Artificial Sequence
  Synthetic Construct
tcactgctgccacctgcata

SEQ ID NO: 26137 - DNA, 21 bp, Artificial Sequence
  Synthetic Construct
actgggactggagcccagatt

SEQ ID NO: 26138 - DNA, 23 bp, Artificial Sequence
  Synthetic Construct
tgaaagaacctcccaacaggttt

SEQ ID NO: 26139 - DNA, 20 bp, Artificial Sequence
  Synthetic Construct
caacccacctcctcccatct

SEQ ID NO: 26140 - DNA, 21 bp, Artificial Sequence
  Synthetic Construct
tggttaggcctggctctgtct

SEQ ID NO: 26141 - DNA, 24 bp, Artificial Sequence
  Synthetic Construct
gccagaatactcaccccagactga

SEQ ID NO: 26142 - DNA, 25 bp, Artificial Sequence
  Synthetic Construct
cctagtatgtgttggcactgacact

SEQ ID NO: 26143 - DNA, 25 bp, Artificial Sequence
  Synthetic Construct
ggctaagccagatgctgttaagtag

SEQ ID NO: 26144 - DNA, 20 bp, Artificial Sequence
  Synthetic Construct
agtgccactgtgtgcaggta

SEQ ID NO: 26145 - DNA, 21 bp, Artificial Sequence
  Synthetic Construct
accaggcacaaggactcatca

SEQ ID NO: 26146 - DNA, 26 bp, Artificial Sequence
  Synthetic Construct
ccacctacattgcctaatttgaggat

SEQ ID NO: 26147 - DNA, 18 bp, Artificial Sequence
  Synthetic Construct
tgcagccagcactgcaaa

SEQ ID NO: 26148 - DNA, 25 bp, Artificial Sequence
  Synthetic Construct
cggagcatgtttaggtgatgtgctt

SEQ ID NO: 26149 - DNA, 22 bp, Artificial Sequence
  Synthetic Construct
catcttggcctttgctctctga

SEQ ID NO: 26150 - DNA, 20 bp, Artificial Sequence
  Synthetic Construct
cccctagggctggagagaca

SEQ ID NO: 26151 - DNA, 19 bp, Artificial Sequence
  Synthetic Construct
gcctctgggtggaagcaat

SEQ ID NO: 26152 - DNA, 19 bp, Artificial Sequence
  Synthetic Construct
aaggccggtgctggctact

SEQ ID NO: 26153 - DNA, 19 bp, Artificial Sequence
  Synthetic Construct
gctccctgccctctctagt

SEQ ID NO: 26154 - DNA, 21 bp, Artificial Sequence
  Synthetic Construct
ccacccagctctcggtgaatg

SEQ ID NO: 26155 - DNA, 20 bp, Artificial Sequence
  Synthetic Construct
tgagctccttgagggcaaag

SEQ ID NO: 26156 - DNA, 20 bp, Artificial Sequence
  Synthetic Construct
gaggcaacagcgactggaat

SEQ ID NO: 26157 - DNA, 18 bp, Artificial Sequence
  Synthetic Construct
tgcctggctaccgctgat

SEQ ID NO: 26158 - DNA, 21 bp, Artificial Sequence
  Synthetic Construct
accgagctgcttttcttccaa

SEQ ID NO: 26159 - DNA, 19 bp, Artificial Sequence
  Synthetic Construct
aacccggaggggaggagaa

SEQ ID NO: 26160 - DNA, 21 bp, Artificial Sequence
  Synthetic Construct
tccccttaggctcctgcgttt

SEQ ID NO: 26161 - DNA, 20 bp, Artificial Sequence
  Synthetic Construct
agaaaggagaggcccctgaa

SEQ ID NO: 26162 - DNA, 22 bp, Artificial Sequence
  Synthetic Construct
ggtgaggtgtgagagggacaga

SEQ ID NO: 26163 - DNA, 19 bp, Artificial Sequence
  Synthetic Construct
ggcctcttgcccagccaat

SEQ ID NO: 26164 - DNA, 21 bp, Artificial Sequence
  Synthetic Construct
ggccagtgctgcctttactga

SEQ ID NO: 26165 - DNA, 20 bp, Artificial Sequence
  Synthetic Construct
cccatcctgcctgcacagaa

SEQ ID NO: 26166 - DNA, 20 bp, Artificial Sequence
  Synthetic Construct
cagggcgccccttctctatg

SEQ ID NO: 26167 - DNA, 20 bp, Artificial Sequence
  Synthetic Construct
ccctcagctctggcatcttg

SEQ ID NO: 26168 - DNA, 20 bp, Artificial Sequence
  Synthetic Construct
tcacagtggcgaggcttgaa

SEQ ID NO: 26169 - DNA, 21 bp, Artificial Sequence
  Synthetic Construct
cccaggggccaggattaacat

SEQ ID NO: 26170 - DNA, 20 bp, Artificial Sequence
  Synthetic Construct
tgggcagcagagcactcaaa

SEQ ID NO: 26171 - DNA, 23 bp, Artificial Sequence
  Synthetic Construct
ggacagctccagggaacaagaaa

SEQ ID NO: 26172 - DNA, 21 bp, Artificial Sequence
  Synthetic Construct
ttctccgggcagcaattacat

SEQ ID NO: 26173 - DNA, 21 bp, Artificial Sequence
  Synthetic Construct
tgggctatggccttcagtttg

SEQ ID NO: 26174 - DNA, 20 bp, Artificial Sequence
  Synthetic Construct
tgcccagttcccagcacact

SEQ ID NO: 26175 - DNA, 20 bp, Artificial Sequence
  Synthetic Construct
gctggacccagaccctctga

SEQ ID NO: 26176 - DNA, 20 bp, Artificial Sequence
  Synthetic Construct
cgaaggtgtctgggctgcaa

SEQ ID NO: 26177 - DNA, 22 bp, Artificial Sequence
  Synthetic Construct
tgacgatgagtggtggtaggtt

SEQ ID NO: 26178 - DNA, 21 bp, Artificial Sequence
  Synthetic Construct
caagcacttcctcacctggat

SEQ ID NO: 26179 - DNA, 19 bp, Artificial Sequence
  Synthetic Construct
tgggccaaaggccccaaga

SEQ ID NO: 26180 - DNA, 22 bp, Artificial Sequence
  Synthetic Construct
aacatttcagccagagggaaca

SEQ ID NO: 26181 - DNA, 20 bp, Artificial Sequence
  Synthetic Construct
ccagcctgggaggctacaga

SEQ ID NO: 26182 - DNA, 26 bp, Artificial Sequence
  Synthetic Construct
cgcgaggagtacaaaataggggagtt

SEQ ID NO: 26183 - DNA, 20 bp, Artificial Sequence
  Synthetic Construct
ggcaaatggaaggggtcaca

SEQ ID NO: 26184 - DNA, 27 bp, Artificial Sequence
  Synthetic Construct
ccaaggtgtagctaacttttcctgtag

SEQ ID NO: 26185 - DNA, 24 bp, Artificial Sequence
  Synthetic Construct
tgacatcctcctgagttgctgcta

SEQ ID NO: 26186 - DNA, 19 bp, Artificial Sequence
  Synthetic Construct
acggaggtgggagcaggtt

SEQ ID NO: 26187 - DNA, 23 bp, Artificial Sequence
  Synthetic Construct
cacatccaacgagctgcagtaga

SEQ ID NO: 26188 - DNA, 21 bp, Artificial Sequence
  Synthetic Construct
tcactccgccactaggagttg

SEQ ID NO: 26189 - DNA, 21 bp, Artificial Sequence
  Synthetic Construct
ccgtgggaagggattgtcatc

SEQ ID NO: 26190 - DNA, 20 bp, Artificial Sequence
  Synthetic Construct
cctggcaatggcaaggaaga

SEQ ID NO: 26191 - DNA, 22 bp, Artificial Sequence
  Synthetic Construct
gcatccacagaatccgttcact

SEQ ID NO: 26192 - DNA, 21 bp, Artificial Sequence
  Synthetic Construct
acagagcaggagctggagcat

SEQ ID NO: 26193 - DNA, 22 bp, Artificial Sequence
  Synthetic Construct
ccagctcagccattcacgcata

SEQ ID NO: 26194 - DNA, 21 bp, Artificial Sequence
  Synthetic Construct
cctttccctctccccttctca

SEQ ID NO: 26195 - DNA, 24 bp, Artificial Sequence
  Synthetic Construct
cctgacagacacctcccatacctt

SEQ ID NO: 26196 - DNA, 22 bp, Artificial Sequence
  Synthetic Construct
gtgccaccaccctcatctaaac

SEQ ID NO: 26197 - DNA, 22 bp, Artificial Sequence
  Synthetic Construct
ggtatcagctaggaggctgtga

SEQ ID NO: 26198 - DNA, 21 bp, Artificial Sequence
  Synthetic Construct
ggcactgggactcgtcaaaac

SEQ ID NO: 26199 - DNA, 20 bp, Artificial Sequence
  Synthetic Construct
gcggttctgcagcatgacaa

SEQ ID NO: 26200 - DNA, 19 bp, Artificial Sequence
  Synthetic Construct
tggcccagccgcagtctaa

SEQ ID NO: 26201 - DNA, 22 bp, Artificial Sequence
  Synthetic Construct
tccagtgaacgactctgtggta

SEQ ID NO: 26202 - DNA, 28 bp, Artificial Sequence
  Synthetic Construct
cagctaatgtgggaggaatttctagact

SEQ ID NO: 26203 - DNA, 22 bp, Artificial Sequence
  Synthetic Construct
agactgagctgtgggaccttct

SEQ ID NO: 26204 - DNA, 19 bp, Artificial Sequence
  Synthetic Construct
tgggatggggccgtagcaa

SEQ ID NO: 26205 - DNA, 22 bp, Artificial Sequence
  Synthetic Construct
accctgagagggtgctacaatg

SEQ ID NO: 26206 - DNA, 21 bp, Artificial Sequence
  Synthetic Construct
gcctctctcgggctcttgact

SEQ ID NO: 26207 - DNA, 21 bp, Artificial Sequence
  Synthetic Construct
agagcacatcccacctgaaga

SEQ ID NO: 26208 - DNA, 21 bp, Artificial Sequence
  Synthetic Construct
agagcctgctctgttctctgt

SEQ ID NO: 26209 - DNA, 20 bp, Artificial Sequence
  Synthetic Construct
tagggcccttggacctgcat

SEQ ID NO: 26210 - DNA, 20 bp, Artificial Sequence
  Synthetic Construct
aatgccgagctggactggtt

SEQ ID NO: 26211 - DNA, 23 bp, Artificial Sequence
  Synthetic Construct
acctggatgtcctgaaactcaac

SEQ ID NO: 26212 - DNA, 21 bp, Artificial Sequence
  Synthetic Construct
agtgccagctcagccctaaga

SEQ ID NO: 26213 - DNA, 22 bp, Artificial Sequence
  Synthetic Construct
gttcgtttgcggaaatgcaaaa

SEQ ID NO: 26214 - DNA, 21 bp, Artificial Sequence
  Synthetic Construct
cagggctggagagacaaactt

SEQ ID NO: 26215 - DNA, 22 bp, Artificial Sequence
  Synthetic Construct
ctgttaaccgcttctcctcctt

SEQ ID NO: 26216 - DNA, 23 bp, Artificial Sequence
  Synthetic Construct
ccctacccagtctcactgctcaa

SEQ ID NO: 26217 - DNA, 20 bp, Artificial Sequence
  Synthetic Construct
tgcacaggcgtgtcacatac

SEQ ID NO: 26218 - DNA, 20 bp, Artificial Sequence
  Synthetic Construct
acctcacctggagggacaag

SEQ ID NO: 26219 - DNA, 23 bp, Artificial Sequence
  Synthetic Construct
gctatgcaggccaaacaggctat

SEQ ID NO: 26220 - DNA, 23 bp, Artificial Sequence
  Synthetic Construct
ggtacctagggtgcaaggcaaag

SEQ ID NO: 26221 - DNA, 20 bp, Artificial Sequence
  Synthetic Construct
gcaagggaaagcggctgact

SEQ ID NO: 26222 - DNA, 22 bp, Artificial Sequence
  Synthetic Construct
gggagaggcgtgaaggaattga

SEQ ID NO: 26223 - DNA, 22 bp, Artificial Sequence
  Synthetic Construct
agatggatcacaggaggcgtaa

SEQ ID NO: 26224 - DNA, 22 bp, Artificial Sequence
  Synthetic Construct
cccaggagtgggagggaatttt

SEQ ID NO: 26225 - DNA, 22 bp, Artificial Sequence
  Synthetic Construct
tccacccattcaacaagggttt

SEQ ID NO: 26226 - DNA, 24 bp, Artificial Sequence
  Synthetic Construct
cgtgaggaacattggccattcaga

SEQ ID NO: 26227 - DNA, 21 bp, Artificial Sequence
  Synthetic Construct
gtgatctggggccttcacttc

SEQ ID NO: 26228 - DNA, 26 bp, Artificial Sequence
  Synthetic Construct
cctgacctgtgcgaagagattaattg

SEQ ID NO: 26229 - DNA, 25 bp, Artificial Sequence
  Synthetic Construct
ccactttgttaggcctgggatcctt

SEQ ID NO: 26230 - DNA, 21 bp, Artificial Sequence
  Synthetic Construct
cttgtgctgagagacctggtt

SEQ ID NO: 26231 - DNA, 20 bp, Artificial Sequence
  Synthetic Construct
gtccctgtctggcgtgtttt

SEQ ID NO: 26232 - DNA, 21 bp, Artificial Sequence
  Synthetic Construct
accccaccctgactccagaag

SEQ ID NO: 26233 - DNA, 19 bp, Artificial Sequence
  Synthetic Construct
agcggaggtctgcttgtct

SEQ ID NO: 26234 - DNA, 26 bp, Artificial Sequence
  Synthetic Construct
ggagtaagaatggacagcaagaagat

SEQ ID NO: 26235 - DNA, 23 bp, Artificial Sequence
  Synthetic Construct
gaaacatcgtgggactcttgtca

SEQ ID NO: 26236 - DNA, 20 bp, Artificial Sequence
  Synthetic Construct
ggtggaagggacgcttgaga

SEQ ID NO: 26237 - DNA, 22 bp, Artificial Sequence
  Synthetic Construct
ccctctaagctaacacggcaat

SEQ ID NO: 26238 - DNA, 23 bp, Artificial Sequence
  Synthetic Construct
agcacctggcacttctaaataca

SEQ ID NO: 26239 - DNA, 23 bp, Artificial Sequence
  Synthetic Construct
cctaggacagaacctctcccata

SEQ ID NO: 26240 - DNA, 19 bp, Artificial Sequence
  Synthetic Construct
tctggcccggcatactcaa

SEQ ID NO: 26241 - DNA, 22 bp, Artificial Sequence
  Synthetic Construct
ggccaagcagtttagggaatga

SEQ ID NO: 26242 - DNA, 22 bp, Artificial Sequence
  Synthetic Construct
gcctccagcaatacctccttgt

SEQ ID NO: 26243 - DNA, 23 bp, Artificial Sequence
  Synthetic Construct
tgacagtttggggccaataagtt

SEQ ID NO: 26244 - DNA, 20 bp, Artificial Sequence
  Synthetic Construct
atccccagcccttcaaccat

SEQ ID NO: 26245 - DNA, 24 bp, Artificial Sequence
  Synthetic Construct
tcagtagctgagctcaaaatgctt

SEQ ID NO: 26246 - DNA, 19 bp, Artificial Sequence
  Synthetic Construct
tggcagggtctcccttgat

SEQ ID NO: 26247 - DNA, 23 bp, Artificial Sequence
  Synthetic Construct
cagaaaggcagcaatttggacat

SEQ ID NO: 26248 - DNA, 19 bp, Artificial Sequence
  Synthetic Construct
ttgtgtccggcgccttgta

SEQ ID NO: 26249 - DNA, 21 bp, Artificial Sequence
  Synthetic Construct
ccagcctccctgagccctaat

SEQ ID NO: 26250 - DNA, 22 bp, Artificial Sequence
  Synthetic Construct
ggccttgggtccaaagcaaaga

SEQ ID NO: 26251 - DNA, 23 bp, Artificial Sequence
  Synthetic Construct
gggttcttctgctcaacggattg

SEQ ID NO: 26252 - DNA, 23 bp, Artificial Sequence
  Synthetic Construct
ggactcttgccctgcttccaaat

SEQ ID NO: 26253 - DNA, 22 bp, Artificial Sequence
  Synthetic Construct
ctcgggtgcatgctatttgtct

SEQ ID NO: 26254 - DNA, 22 bp, Artificial Sequence
  Synthetic Construct
tgaagtggagggagctgatagt

SEQ ID NO: 26255 - DNA, 23 bp, Artificial Sequence
  Synthetic Construct
gcaattgtgtaggtggagacaga

SEQ ID NO: 26256 - DNA, 21 bp, Artificial Sequence
  Synthetic Construct
aagggccacctctccttggaa

SEQ ID NO: 26257 - DNA, 21 bp, Artificial Sequence
  Synthetic Construct
caccatgctccacagatcctt

SEQ ID NO: 26258 - DNA, 20 bp, Artificial Sequence
  Synthetic Construct
gccattctgtgtggctccaa

SEQ ID NO: 26259 - DNA, 27 bp, Artificial Sequence
  Synthetic Construct
gtcaggtaaaaggctgagacttaattg

SEQ ID NO: 26260 - DNA, 22 bp, Artificial Sequence
  Synthetic Construct
gtcctgctgcaagaaccagctt

SEQ ID NO: 26261 - DNA, 25 bp, Artificial Sequence
  Synthetic Construct
cgtggttagccttgattctgttttc

SEQ ID NO: 26262 - DNA, 22 bp, Artificial Sequence
  Synthetic Construct
gtcacccacctacactggcaaa

SEQ ID NO: 26263 - DNA, 24 bp, Artificial Sequence
  Synthetic Construct
tctctcctttcctcaagctgaatg

SEQ ID NO: 26264 - DNA, 24 bp, Artificial Sequence
  Synthetic Construct
ccctggaaggtcctaggttgcttt

SEQ ID NO: 26265 - DNA, 20 bp, Artificial Sequence
  Synthetic Construct
ccatgcagttcggccatgat

SEQ ID NO: 26266 - DNA, 23 bp, Artificial Sequence
  Synthetic Construct
ttgaaagcatggacctcgtaagt

SEQ ID NO: 26267 - DNA, 22 bp, Artificial Sequence
  Synthetic Construct
ggtctccaaaagtggtcactca

SEQ ID NO: 26268 - DNA, 22 bp, Artificial Sequence
  Synthetic Construct
ggcccctatatggcccattgaa

SEQ ID NO: 26269 - DNA, 20 bp, Artificial Sequence
  Synthetic Construct
accgccgcctagactaaaag

SEQ ID NO: 26270 - DNA, 20 bp, Artificial Sequence
  Synthetic Construct
ccccactggatctgcaccat

SEQ ID NO: 26271 - DNA, 23 bp, Artificial Sequence
  Synthetic Construct
ctgggtgcccctacattcatttg

SEQ ID NO: 26272 - DNA, 21 bp, Artificial Sequence
  Synthetic Construct
cacaccactgtcctggtcatc

SEQ ID NO: 26273 - DNA, 20 bp, Artificial Sequence
  Synthetic Construct
ggcagaagccagaacagtca

SEQ ID NO: 26274 - DNA, 21 bp, Artificial Sequence
  Synthetic Construct
ccagtgggagttagcctgatg

SEQ ID NO: 26275 - DNA, 22 bp, Artificial Sequence
  Synthetic Construct
tggaggtggccttgacctttga

SEQ ID NO: 26276 - DNA, 21 bp, Artificial Sequence
  Synthetic Construct
agaagccacgccatggataaa

SEQ ID NO: 26277 - DNA, 22 bp, Artificial Sequence
  Synthetic Construct
gggcatacagaagcaccaatca

SEQ ID NO: 26278 - DNA, 23 bp, Artificial Sequence
  Synthetic Construct
cttgaggacggcaaatgctgtat

SEQ ID NO: 26279 - DNA, 23 bp, Artificial Sequence
  Synthetic Construct
cctgggctagtacagaacacatc

SEQ ID NO: 26280 - DNA, 22 bp, Artificial Sequence
  Synthetic Construct
gaatctcggggctcttctgtct

SEQ ID NO: 26281 - DNA, 24 bp, Artificial Sequence
  Synthetic Construct
cccctggaagaagtttggggctat

SEQ ID NO: 26282 - DNA, 24 bp, Artificial Sequence
  Synthetic Construct
atcttcctggtgtttcactccttt

SEQ ID NO: 26283 - DNA, 26 bp, Artificial Sequence
  Synthetic Construct
caatcaacctagttcaggagtacagt

SEQ ID NO: 26284 - DNA, 21 bp, Artificial Sequence
  Synthetic Construct
ttctggcctcacaagcaaagt

SEQ ID NO: 26285 - DNA, 21 bp, Artificial Sequence
  Synthetic Construct
cctgatcgctggctgtcagat

SEQ ID NO: 26286 - DNA, 20 bp, Artificial Sequence
  Synthetic Construct
tggggccagcatttggtgtt

SEQ ID NO: 26287 - DNA, 25 bp, Artificial Sequence
  Synthetic Construct
gtacctttatccccagtggtcttca

SEQ ID NO: 26288 - DNA, 21 bp, Artificial Sequence
  Synthetic Construct
agccctgtgagcctcagattc

SEQ ID NO: 26289 - DNA, 23 bp, Artificial Sequence
  Synthetic Construct
gtgtgcccatattaggtccttga

SEQ ID NO: 26290 - DNA, 23 bp, Artificial Sequence
  Synthetic Construct
gactatgccacctgcttgctgta

SEQ ID NO: 26291 - DNA, 24 bp, Artificial Sequence
  Synthetic Construct
cagggcatcatgatcagtttggaa

SEQ ID NO: 26292 - DNA, 24 bp, Artificial Sequence
  Synthetic Construct
caggacacacgttaaagccacaga

SEQ ID NO: 26293 - DNA, 23 bp, Artificial Sequence
  Synthetic Construct
catgccagaaccattctcgtctt

SEQ ID NO: 26294 - DNA, 20 bp, Artificial Sequence
  Synthetic Construct
ggccagcaactgggtctcta

SEQ ID NO: 26295 - DNA, 23 bp, Artificial Sequence
  Synthetic Construct
tcaggatatctgctcccttccat

SEQ ID NO: 26296 - DNA, 26 bp, Artificial Sequence
  Synthetic Construct
ccatctgctgtagcgaatatgtgaag

SEQ ID NO: 26297 - DNA, 24 bp, Artificial Sequence
  Synthetic Construct
catacctaagcaatttggctgcaa

SEQ ID NO: 26298 - DNA, 20 bp, Artificial Sequence
  Synthetic Construct
ccagctcagaggaccagcta

SEQ ID NO: 26299 - DNA, 19 bp, Artificial Sequence
  Synthetic Construct
ttggctggggcgagggtat

SEQ ID NO: 26300 - DNA, 23 bp, Artificial Sequence
  Synthetic Construct
tcatggttccttctggggaaatg

SEQ ID NO: 26301 - DNA, 24 bp, Artificial Sequence
  Synthetic Construct
cttccatgtccaacagatctgaca

SEQ ID NO: 26302 - DNA, 20 bp, Artificial Sequence
  Synthetic Construct
cagcaaggccatgtgtcaac

SEQ ID NO: 26303 - DNA, 20 bp, Artificial Sequence
  Synthetic Construct
gcagtgacaggaccgcatga

SEQ ID NO: 26304 - DNA, 26 bp, Artificial Sequence
  Synthetic Construct
cagtagtaccaccctaaccacctttg

SEQ ID NO: 26305 - DNA, 24 bp, Artificial Sequence
  Synthetic Construct
ctcaatggggtgattggcctcata

SEQ ID NO: 26306 - DNA, 20 bp, Artificial Sequence
  Synthetic Construct
ctttgtccagccccaacact

SEQ ID NO: 26307 - DNA, 27 bp, Artificial Sequence
  Synthetic Construct
gttgacccaaaccaatcagatacttca

SEQ ID NO: 26308 - DNA, 24 bp, Artificial Sequence
  Synthetic Construct
gggttggtgtctattcctgtcaag

SEQ ID NO: 26309 - DNA, 23 bp, Artificial Sequence
  Synthetic Construct
cacctctctgagttgcactttct

SEQ ID NO: 26310 - DNA, 20 bp, Artificial Sequence
  Synthetic Construct
agttcgccaacctccaaaca

SEQ ID NO: 26311 - DNA, 22 bp, Artificial Sequence
  Synthetic Construct
gcctcacgtcttttagctctgt

SEQ ID NO: 26312 - DNA, 20 bp, Artificial Sequence
  Synthetic Construct
ccgcatccagcgaccaaagt

SEQ ID NO: 26313 - DNA, 22 bp, Artificial Sequence
  Synthetic Construct
gtgtggcagcagcagagtaagt

SEQ ID NO: 26314 - DNA, 20 bp, Artificial Sequence
  Synthetic Construct
tcactgcctctccctcaact

SEQ ID NO: 26315 - DNA, 20 bp, Artificial Sequence
  Synthetic Construct
ccacaaagcgggctggaaaa

SEQ ID NO: 26316 - DNA, 21 bp, Artificial Sequence
  Synthetic Construct
aaacggcaggaggctctgtca

SEQ ID NO: 26317 - DNA, 19 bp, Artificial Sequence
  Synthetic Construct
tgagactgggaggcagcaa

SEQ ID NO: 26318 - DNA, 26 bp, Artificial Sequence
  Synthetic Construct
gtttcggttgagtagagttacctgat

SEQ ID NO: 26319 - DNA, 22 bp, Artificial Sequence
  Synthetic Construct
ggcatgggtgtgtagctgtttg

SEQ ID NO: 26320 - DNA, 22 bp, Artificial Sequence
  Synthetic Construct
cgttcatcaaccagcggagtct

SEQ ID NO: 26321 - DNA, 22 bp, Artificial Sequence
  Synthetic Construct
ccaacacttggcactgaactga

SEQ ID NO: 26322 - DNA, 20 bp, Artificial Sequence
  Synthetic Construct
ttctgctgcctgggaacttg

SEQ ID NO: 26323 - DNA, 22 bp, Artificial Sequence
  Synthetic Construct
caacctccttggctttgacaga

SEQ ID NO: 26324 - DNA, 23 bp, Artificial Sequence
  Synthetic Construct
tgcacactgattgtcaccattct

SEQ ID NO: 26325 - DNA, 23 bp, Artificial Sequence
  Synthetic Construct
ttcaggctcccctggtaccatac

SEQ ID NO: 26326 - DNA, 19 bp, Artificial Sequence
  Synthetic Construct
agcccagggtcctgtgtca

SEQ ID NO: 26327 - DNA, 23 bp, Artificial Sequence
  Synthetic Construct
cttctccatgctcactctgcatt

SEQ ID NO: 26328 - DNA, 25 bp, Artificial Sequence
  Synthetic Construct
aggcaatttaaagttggagccagta

SEQ ID NO: 26329 - DNA, 23 bp, Artificial Sequence
  Synthetic Construct
ggacctgaacggggactcttttg

SEQ ID NO: 26330 - DNA, 21 bp, Artificial Sequence
  Synthetic Construct
cagctaccccacagcgaacta

SEQ ID NO: 26331 - DNA, 23 bp, Artificial Sequence
  Synthetic Construct
caagtagctggactaggctgcat

SEQ ID NO: 26332 - DNA, 21 bp, Artificial Sequence
  Synthetic Construct
aagcacagtggtcatggttga

SEQ ID NO: 26333 - DNA, 23 bp, Artificial Sequence
  Synthetic Construct
cctgcctatgttaccctttccat

SEQ ID NO: 26334 - DNA, 27 bp, Artificial Sequence
  Synthetic Construct
gcaccagagaattaatcagatcgtttg

SEQ ID NO: 26335 - DNA, 22 bp, Artificial Sequence
  Synthetic Construct
ggacaagcactgcccacatagt

SEQ ID NO: 26336 - DNA, 20 bp, Artificial Sequence
  Synthetic Construct
gtggcggtcactgcttaact

SEQ ID NO: 26337 - DNA, 20 bp, Artificial Sequence
  Synthetic Construct
ggcctggccaagggtaggat

SEQ ID NO: 26338 - DNA, 23 bp, Artificial Sequence
  Synthetic Construct
ggccagtccagtccaagggaata

SEQ ID NO: 26339 - DNA, 21 bp, Artificial Sequence
  Synthetic Construct
tcttgggctatgcagcaactt

SEQ ID NO: 26340 - DNA, 20 bp, Artificial Sequence
  Synthetic Construct
cacatgccccacttcaggat

SEQ ID NO: 26341 - DNA, 22 bp, Artificial Sequence
  Synthetic Construct
cagtgttcccagaggcaacttc

SEQ ID NO: 26342 - DNA, 25 bp, Artificial Sequence
  Synthetic Construct
ggacaagagaagtatgccaaagatg

SEQ ID NO: 26343 - DNA, 24 bp, Artificial Sequence
  Synthetic Construct
cctagagattacgggcagtccaaa

SEQ ID NO: 26344 - DNA, 20 bp, Artificial Sequence
  Synthetic Construct
agcgccttgactcctcttca

SEQ ID NO: 26345 - DNA, 22 bp, Artificial Sequence
  Synthetic Construct
attggccattgccaggcacaga

SEQ ID NO: 26346 - DNA, 18 bp, Artificial Sequence
  Synthetic Construct
aggccctcagcgaacctt

SEQ ID NO: 26347 - DNA, 20 bp, Artificial Sequence
  Synthetic Construct
tgctccaacccctgatcaac

SEQ ID NO: 26348 - DNA, 22 bp, Artificial Sequence
  Synthetic Construct
accctgactacaactgcactga

SEQ ID NO: 26349 - DNA, 22 bp, Artificial Sequence
  Synthetic Construct
ggcctgggaaaaggagcaagat

SEQ ID NO: 26350 - DNA, 25 bp, Artificial Sequence
  Synthetic Construct
gtcgtcctctatgtggagaatgaga

SEQ ID NO: 26351 - DNA, 20 bp, Artificial Sequence
  Synthetic Construct
acccaggatgagtgcagaga

SEQ ID NO: 26352 - DNA, 22 bp, Artificial Sequence
  Synthetic Construct
cccctcaaacagaccacacata

SEQ ID NO: 26353 - DNA, 22 bp, Artificial Sequence
  Synthetic Construct
agggagccctttggcttctaca

SEQ ID NO: 26354 - DNA, 21 bp, Artificial Sequence
  Synthetic Construct
ggccagtttctggtcttcctt

SEQ ID NO: 26355 - DNA, 20 bp, Artificial Sequence
  Synthetic Construct
cttcctggggcagctagtgt

SEQ ID NO: 26356 - DNA, 24 bp, Artificial Sequence
  Synthetic Construct
gttccagtagcccatcttgctatg

SEQ ID NO: 26357 - DNA, 20 bp, Artificial Sequence
  Synthetic Construct
tagccttcccgagctgaaga

SEQ ID NO: 26358 - DNA, 20 bp, Artificial Sequence
  Synthetic Construct
gggacggaagtggcctgaga

SEQ ID NO: 26359 - DNA, 20 bp, Artificial Sequence
  Synthetic Construct
ctccctgaggctggcctttc

SEQ ID NO: 26360 - DNA, 21 bp, Artificial Sequence
  Synthetic Construct
ggagcacccagcttcagtgtt

SEQ ID NO: 26361 - DNA, 20 bp, Artificial Sequence
  Synthetic Construct
aacgaggaaggccggtgatt

SEQ ID NO: 26362 - DNA, 21 bp, Artificial Sequence
  Synthetic Construct
tgatgacggtgatggcagaca

SEQ ID NO: 26363 - DNA, 23 bp, Artificial Sequence
  Synthetic Construct
tccgcaggtacttcatagaggat

SEQ ID NO: 26364 - DNA, 22 bp, Artificial Sequence
  Synthetic Construct
ccacctgatgcattcccactca

SEQ ID NO: 26365 - DNA, 24 bp, Artificial Sequence
  Synthetic Construct
tgagggatcttgcacagtaacttc

SEQ ID NO: 26366 - DNA, 21 bp, Artificial Sequence
  Synthetic Construct
aggtgctaggcactcctcaca

SEQ ID NO: 26367 - DNA, 21 bp, Artificial Sequence
  Synthetic Construct
gcaccaggctcttcagggttt

SEQ ID NO: 26368 - DNA, 25 bp, Artificial Sequence
  Synthetic Construct
gcaggccaaattgaggactatggtt

SEQ ID NO: 26369 - DNA, 26 bp, Artificial Sequence
  Synthetic Construct
cttctcttccctatttcgtcttcgtt

SEQ ID NO: 26370 - DNA, 22 bp, Artificial Sequence
  Synthetic Construct
ggtgggagtaatggcagtctga

SEQ ID NO: 26371 - DNA, 23 bp, Artificial Sequence
  Synthetic Construct
gcagagaggacactcacccatct

SEQ ID NO: 26372 - DNA, 21 bp, Artificial Sequence
  Synthetic Construct
tgggtccttgcctagttgaga

SEQ ID NO: 26373 - DNA, 19 bp, Artificial Sequence
  Synthetic Construct
ttccgcggacagtgcagat

SEQ ID NO: 26374 - DNA, 23 bp, Artificial Sequence
  Synthetic Construct
cacagctctgctctccaccatag

SEQ ID NO: 26375 - DNA, 20 bp, Artificial Sequence
  Synthetic Construct
aaacgagtcgaggccagtca

SEQ ID NO: 26376 - DNA, 23 bp, Artificial Sequence
  Synthetic Construct
cgtgaggtcatgtttgagctgta

SEQ ID NO: 26377 - DNA, 20 bp, Artificial Sequence
  Synthetic Construct
tgaggtgctggctgggatgt

SEQ ID NO: 26378 - DNA, 22 bp, Artificial Sequence
  Synthetic Construct
gccaggctcacgcacataatca

SEQ ID NO: 26379 - DNA, 24 bp, Artificial Sequence
  Synthetic Construct
ggggtggtatccatctttcactgt

SEQ ID NO: 26380 - DNA, 23 bp, Artificial Sequence
  Synthetic Construct
ttagccgagtccttagcatcatc

SEQ ID NO: 26381 - DNA, 20 bp, Artificial Sequence
  Synthetic Construct
tggaggtcccagggctctaa

SEQ ID NO: 26382 - DNA, 24 bp, Artificial Sequence
  Synthetic Construct
cctgtgattactgcagcaggtgtt

SEQ ID NO: 26383 - DNA, 20 bp, Artificial Sequence
  Synthetic Construct
tgttgggcccctcaacatca

SEQ ID NO: 26384 - DNA, 25 bp, Artificial Sequence
  Synthetic Construct
ccccaacttaggctcgaagtaccat

SEQ ID NO: 26385 - DNA, 24 bp, Artificial Sequence
  Synthetic Construct
gcccagaccagaaattccaagatg

SEQ ID NO: 26386 - DNA, 22 bp, Artificial Sequence
  Synthetic Construct
aggtcgtggagtctgataccaa

SEQ ID NO: 26387 - DNA, 23 bp, Artificial Sequence
  Synthetic Construct
gcaagagtggccataatcacttg

SEQ ID NO: 26388 - DNA, 22 bp, Artificial Sequence
  Synthetic Construct
ccagcttggccacagaaaggta

SEQ ID NO: 26389 - DNA, 26 bp, Artificial Sequence
  Synthetic Construct
ggaaagttttaagtaggaggcagtga

SEQ ID NO: 26390 - DNA, 19 bp, Artificial Sequence
  Synthetic Construct
cctgcagagccgagtggat

SEQ ID NO: 26391 - DNA, 21 bp, Artificial Sequence
  Synthetic Construct
ttgttctgcagctcaccagat

SEQ ID NO: 26392 - DNA, 19 bp, Artificial Sequence
  Synthetic Construct
caaccagccacctgtgtgt

SEQ ID NO: 26393 - DNA, 19 bp, Artificial Sequence
  Synthetic Construct
tctgcctgggctcctgctt

SEQ ID NO: 26394 - DNA, 22 bp, Artificial Sequence
  Synthetic Construct
ggagccacaacagtgattccat

SEQ ID NO: 26395 - DNA, 22 bp, Artificial Sequence
  Synthetic Construct
cccgaagcacatctctggtcat

SEQ ID NO: 26396 - DNA, 24 bp, Artificial Sequence
  Synthetic Construct
cctgcaaaggcagctgagctaaag

SEQ ID NO: 26397 - DNA, 22 bp, Artificial Sequence
  Synthetic Construct
tcacataggccacatcccttca

SEQ ID NO: 26398 - DNA, 20 bp, Artificial Sequence
  Synthetic Construct
aggaaagtggcctgctgtga

SEQ ID NO: 26399 - DNA, 23 bp, Artificial Sequence
  Synthetic Construct
ctaagggactcacccttcacttc

SEQ ID NO: 26400 - DNA, 21 bp, Artificial Sequence
  Synthetic Construct
tccctggaacccaacttcaga

SEQ ID NO: 26401 - DNA, 22 bp, Artificial Sequence
  Synthetic Construct
gggaaaagagggctctggaaca

SEQ ID NO: 26402 - DNA, 21 bp, Artificial Sequence
  Synthetic Construct
aggcggtttcacatcttctgt

SEQ ID NO: 26403 - DNA, 20 bp, Artificial Sequence
  Synthetic Construct
gaagccttgcagctgctttc

SEQ ID NO: 26404 - DNA, 22 bp, Artificial Sequence
  Synthetic Construct
gtcataccagctggcccaacaa

SEQ ID NO: 26405 - DNA, 20 bp, Artificial Sequence
  Synthetic Construct
ggtgctggggatgcagtttc

SEQ ID NO: 26406 - DNA, 20 bp, Artificial Sequence
  Synthetic Construct
agaccccattcaggcactct

SEQ ID NO: 26407 - DNA, 22 bp, Artificial Sequence
  Synthetic Construct
tgccctcctactgctggactaa

SEQ ID NO: 26408 - DNA, 22 bp, Artificial Sequence
  Synthetic Construct
gctggagtgagtgaggcagact

SEQ ID NO: 26409 - DNA, 22 bp, Artificial Sequence
  Synthetic Construct
ggaatccaaacaggcacagtga

SEQ ID NO: 26410 - DNA, 26 bp, Artificial Sequence
  Synthetic Construct
ggaagggaatttgagcaagctgtttc

SEQ ID NO: 26411 - DNA, 22 bp, Artificial Sequence
  Synthetic Construct
tggaaggctgtaccctcggttt

SEQ ID NO: 26412 - DNA, 19 bp, Artificial Sequence
  Synthetic Construct
tgggaagctggcctcactt

SEQ ID NO: 26413 - DNA, 20 bp, Artificial Sequence
  Synthetic Construct
acttcctggcaccctgaaac

SEQ ID NO: 26414 - DNA, 22 bp, Artificial Sequence
  Synthetic Construct
agaacagagggcaggtcacact

SEQ ID NO: 26415 - DNA, 23 bp, Artificial Sequence
  Synthetic Construct
gcatccttaacaagcaccaacat

SEQ ID NO: 26416 - DNA, 19 bp, Artificial Sequence
  Synthetic Construct
cccagggctcagccgaaat

SEQ ID NO: 26417 - DNA, 24 bp, Artificial Sequence
  Synthetic Construct
cctcagtggtgaggagactgtttg

SEQ ID NO: 26418 - DNA, 19 bp, Artificial Sequence
  Synthetic Construct
ggcatggtggcgccttttg

SEQ ID NO: 26419 - DNA, 24 bp, Artificial Sequence
  Synthetic Construct
gaatctgcccactttcaccattct

SEQ ID NO: 26420 - DNA, 22 bp, Artificial Sequence
  Synthetic Construct
ggtgggcagtaaaaaggggatt

SEQ ID NO: 26421 - DNA, 22 bp, Artificial Sequence
  Synthetic Construct
aggagaaagagcctgggcttca

SEQ ID NO: 26422 - DNA, 21 bp, Artificial Sequence
  Synthetic Construct
gcttccttctggcccactgtt

SEQ ID NO: 26423 - DNA, 22 bp, Artificial Sequence
  Synthetic Construct
tctggcctgtggctctctacaa

SEQ ID NO: 26424 - DNA, 20 bp, Artificial Sequence
  Synthetic Construct
accgtgggaaagtgcaggaa

SEQ ID NO: 26425 - DNA, 24 bp, Artificial Sequence
  Synthetic Construct
cacgaagacgaatgtatgcacaac

SEQ ID NO: 26426 - DNA, 18 bp, Artificial Sequence
  Synthetic Construct
gcagctggctggctttca

SEQ ID NO: 26427 - DNA, 19 bp, Artificial Sequence
  Synthetic Construct
acccagcacctggaaggat

SEQ ID NO: 26428 - DNA, 20 bp, Artificial Sequence
  Synthetic Construct
accacaggctggctgatttc

SEQ ID NO: 26429 - DNA, 21 bp, Artificial Sequence
  Synthetic Construct
ggcaaagggactgcctcttct

SEQ ID NO: 26430 - DNA, 27 bp, Artificial Sequence
  Synthetic Construct
ctacatatacctgagcatcccatcaac

SEQ ID NO: 26431 - DNA, 21 bp, Artificial Sequence
  Synthetic Construct
gctgcggaagcagaggaactt

SEQ ID NO: 26432 - DNA, 27 bp, Artificial Sequence
  Synthetic Construct
gcaagtggtattttgggaggtgacata

SEQ ID NO: 26433 - DNA, 20 bp, Artificial Sequence
  Synthetic Construct
aagcagctggggtgcagtgt

SEQ ID NO: 26434 - DNA, 22 bp, Artificial Sequence
  Synthetic Construct
ccagcatcctcccaatttccat

SEQ ID NO: 26435 - DNA, 27 bp, Artificial Sequence
  Synthetic Construct
caccctctgtgactcacttttccatta

SEQ ID NO: 26436 - DNA, 22 bp, Artificial Sequence
  Synthetic Construct
ccacaggtttgggacagtgtaa

SEQ ID NO: 26437 - DNA, 22 bp, Artificial Sequence
  Synthetic Construct
ctgggccattgtctggcctatt

SEQ ID NO: 26438 - DNA, 19 bp, Artificial Sequence
  Synthetic Construct
ccatgcctggggtgactga

SEQ ID NO: 26439 - DNA, 20 bp, Artificial Sequence
  Synthetic Construct
aggtgcttgtggcgtgtttg

SEQ ID NO: 26440 - DNA, 19 bp, Artificial Sequence
  Synthetic Construct
tggaggcccaagggtgtca

SEQ ID NO: 26441 - DNA, 19 bp, Artificial Sequence
  Synthetic Construct
accctaggccccagcatca

SEQ ID NO: 26442 - DNA, 19 bp, Artificial Sequence
  Synthetic Construct
cctcctgcaaggcgtggaa

SEQ ID NO: 26443 - DNA, 25 bp, Artificial Sequence
  Synthetic Construct
tgctttgagtttctgggactagttt

SEQ ID NO: 26444 - DNA, 22 bp, Artificial Sequence
  Synthetic Construct
gaggctgtaaggcagccacttt

SEQ ID NO: 26445 - DNA, 21 bp, Artificial Sequence
  Synthetic Construct
gacatggggccaagtgatctt

SEQ ID NO: 26446 - DNA, 24 bp, Artificial Sequence
  Synthetic Construct
gatcatcctcttgacagggagttg

SEQ ID NO: 26447 - DNA, 22 bp, Artificial Sequence
  Synthetic Construct
tgcctggcctggttgtacttct

SEQ ID NO: 26448 - DNA, 22 bp, Artificial Sequence
  Synthetic Construct
ggatcgcgggtttcatccagaa

SEQ ID NO: 26449 - DNA, 22 bp, Artificial Sequence
  Synthetic Construct
ctgcaccggccaaaatgaggat

SEQ ID NO: 26450 - DNA, 26 bp, Artificial Sequence
  Synthetic Construct
acagaagcccagtttggtatatgtag

SEQ ID NO: 26451 - DNA, 27 bp, Artificial Sequence
  Synthetic Construct
gtggattcctgttttgttctcaacttc

SEQ ID NO: 26452 - DNA, 22 bp, Artificial Sequence
  Synthetic Construct
tgcccagaagtgcctagaaaac

SEQ ID NO: 26453 - DNA, 22 bp, Artificial Sequence
  Synthetic Construct
ccagcaagaagacagagtgtca

SEQ ID NO: 26454 - DNA, 21 bp, Artificial Sequence
  Synthetic Construct
ctgtctgctggggtagagttg

SEQ ID NO: 26455 - DNA, 22 bp, Artificial Sequence
  Synthetic Construct
tcatccctacagctgggaccat

SEQ ID NO: 26456 - DNA, 24 bp, Artificial Sequence
  Synthetic Construct
caggcactctacaccaggagaaat

SEQ ID NO: 26457 - DNA, 21 bp, Artificial Sequence
  Synthetic Construct
gaggcagctctgagcatacaa

SEQ ID NO: 26458 - DNA, 23 bp, Artificial Sequence
  Synthetic Construct
cccaagtgaggcatagtggtttc

SEQ ID NO: 26459 - DNA, 22 bp, Artificial Sequence
  Synthetic Construct
cgccccgactttgtctttgact

SEQ ID NO: 26460 - DNA, 23 bp, Artificial Sequence
  Synthetic Construct
gtctgttggatgttgctgtttca

SEQ ID NO: 26461 - DNA, 22 bp, Artificial Sequence
  Synthetic Construct
gggcataatcagggagccagaa

SEQ ID NO: 26462 - DNA, 24 bp, Artificial Sequence
  Synthetic Construct
ggagaccattggcctgcttcatag

SEQ ID NO: 26463 - DNA, 22 bp, Artificial Sequence
  Synthetic Construct
acactttgaacgtccaggcaaa

SEQ ID NO: 26464 - DNA, 24 bp, Artificial Sequence
  Synthetic Construct
gagtcctgggatgtgaaccatcta

SEQ ID NO: 26465 - DNA, 20 bp, Artificial Sequence
  Synthetic Construct
ttcaggactggtgcctgctt

SEQ ID NO: 26466 - DNA, 21 bp, Artificial Sequence
  Synthetic Construct
tgaggccacctcccagataaa

SEQ ID NO: 26467 - DNA, 19 bp, Artificial Sequence
  Synthetic Construct
gcacagcaggttgctctca

SEQ ID NO: 26468 - DNA, 22 bp, Artificial Sequence
  Synthetic Construct
tgaagaggtttgctgcacacta

SEQ ID NO: 26469 - DNA, 20 bp, Artificial Sequence
  Synthetic Construct
agcccctcatcactgtggta

SEQ ID NO: 26470 - DNA, 20 bp, Artificial Sequence
  Synthetic Construct
ctttcgggttgtgcctgcat

SEQ ID NO: 26471 - DNA, 19 bp, Artificial Sequence
  Synthetic Construct
acctggcacgttccgtaca

SEQ ID NO: 26472 - DNA, 24 bp, Artificial Sequence
  Synthetic Construct
ggcttccacccacatactaagaca

SEQ ID NO: 26473 - DNA, 23 bp, Artificial Sequence
  Synthetic Construct
ctggggtctgaaggcagagagta

SEQ ID NO: 26474 - DNA, 20 bp, Artificial Sequence
  Synthetic Construct
tgggacgcctctcccctctt

SEQ ID NO: 26475 - DNA, 20 bp, Artificial Sequence
  Synthetic Construct
tccatgacaggcagcacagt

SEQ ID NO: 26476 - DNA, 22 bp, Artificial Sequence
  Synthetic Construct
gagcatagagcgtgcagggaaa

SEQ ID NO: 26477 - DNA, 20 bp, Artificial Sequence
  Synthetic Construct
atgccagggtgccaaagtct

SEQ ID NO: 26478 - DNA, 21 bp, Artificial Sequence
  Synthetic Construct
cagggcttgtggagaaagcat

SEQ ID NO: 26479 - DNA, 22 bp, Artificial Sequence
  Synthetic Construct
agtgctggctgttgcctctttc

SEQ ID NO: 26480 - DNA, 22 bp, Artificial Sequence
  Synthetic Construct
ggggaagcatggtggaagtagt

SEQ ID NO: 26481 - DNA, 19 bp, Artificial Sequence
  Synthetic Construct
tcggctccctgccagcaaa

SEQ ID NO: 26482 - DNA, 20 bp, Artificial Sequence
  Synthetic Construct
ggaagcatccggctctgact

SEQ ID NO: 26483 - DNA, 20 bp, Artificial Sequence
  Synthetic Construct
ttgccaggggcacagcaaaa

SEQ ID NO: 26484 - DNA, 20 bp, Artificial Sequence
  Synthetic Construct
gtgcatgccagcctgatttc

SEQ ID NO: 26485 - DNA, 19 bp, Artificial Sequence
  Synthetic Construct
aggcctgctctggcatgtt

SEQ ID NO: 26486 - DNA, 20 bp, Artificial Sequence
  Synthetic Construct
agcaaggggtggggtttgaa

SEQ ID NO: 26487 - DNA, 22 bp, Artificial Sequence
  Synthetic Construct
tgtagaggggcctgactgttct

SEQ ID NO: 26488 - DNA, 25 bp, Artificial Sequence
  Synthetic Construct
cactttgtctcttggtggagagtgt

SEQ ID NO: 26489 - DNA, 20 bp, Artificial Sequence
  Synthetic Construct
accgtgcctggctgattgtt

SEQ ID NO: 26490 - DNA, 21 bp, Artificial Sequence
  Synthetic Construct
ggccatggcagaaatgcaaga

SEQ ID NO: 26491 - DNA, 21 bp, Artificial Sequence
  Synthetic Construct
caggccctagctcctggatga

SEQ ID NO: 26492 - DNA, 22 bp, Artificial Sequence
  Synthetic Construct
gaccaagggcaggttacagaga

SEQ ID NO: 26493 - DNA, 26 bp, Artificial Sequence
  Synthetic Construct
tcccagaataagaggtatgtggatca

SEQ ID NO: 26494 - DNA, 21 bp, Artificial Sequence
  Synthetic Construct
tgtgcatggcccatcctatct

SEQ ID NO: 26495 - DNA, 20 bp, Artificial Sequence
  Synthetic Construct
aacagggcaggcaggcagtt

SEQ ID NO: 26496 - DNA, 22 bp, Artificial Sequence
  Synthetic Construct
gaggcccatttccacacagtga

SEQ ID NO: 26497 - DNA, 20 bp, Artificial Sequence
  Synthetic Construct
gccccattgtccacgtcata

SEQ ID NO: 26498 - DNA, 20 bp, Artificial Sequence
  Synthetic Construct
caccatgcccagccagaact

SEQ ID NO: 26499 - DNA, 20 bp, Artificial Sequence
  Synthetic Construct
ggcagagagggtcctgttgt

SEQ ID NO: 26500 - DNA, 21 bp, Artificial Sequence
  Synthetic Construct
gcccaagagagacacgctgat

SEQ ID NO: 26501 - DNA, 22 bp, Artificial Sequence
  Synthetic Construct
accaccaccctctctccacaaa

SEQ ID NO: 26502 - DNA, 24 bp, Artificial Sequence
  Synthetic Construct
gaattcataggtagggtggtggtt

SEQ ID NO: 26503 - DNA, 23 bp, Artificial Sequence
  Synthetic Construct
ggctgatggtactcgttctccaa

SEQ ID NO: 26504 - DNA, 22 bp, Artificial Sequence
  Synthetic Construct
tcccgctgctaaactgctgaag

SEQ ID NO: 26505 - DNA, 22 bp, Artificial Sequence
  Synthetic Construct
gccagtgccagtctgaaagcat

SEQ ID NO: 26506 - DNA, 24 bp, Artificial Sequence
  Synthetic Construct
cctaggtgggaaccactgaaggta

SEQ ID NO: 26507 - DNA, 20 bp, Artificial Sequence
  Synthetic Construct
ttcagggaaggccctactgt

SEQ ID NO: 26508 - DNA, 19 bp, Artificial Sequence
  Synthetic Construct
gcatgggctgcagtggaaa

SEQ ID NO: 26509 - DNA, 22 bp, Artificial Sequence
  Synthetic Construct
cctcagcaggggaaagaagcaa

SEQ ID NO: 26510 - DNA, 20 bp, Artificial Sequence
  Synthetic Construct
cgcaccacagtggcaaatct

SEQ ID NO: 26511 - DNA, 20 bp, Artificial Sequence
  Synthetic Construct
gcagtacctgcggtgagcat

SEQ ID NO: 26512 - DNA, 24 bp, Artificial Sequence
  Synthetic Construct
cccaaatttcttcggcttcacgat

SEQ ID NO: 26513 - DNA, 21 bp, Artificial Sequence
  Synthetic Construct
agggttggaaggggagactga

SEQ ID NO: 26514 - DNA, 22 bp, Artificial Sequence
  Synthetic Construct
gcttcagctgggatggtggtta

SEQ ID NO: 26515 - DNA, 21 bp, Artificial Sequence
  Synthetic Construct
cccagggtgagaacccaagtt

SEQ ID NO: 26516 - DNA, 22 bp, Artificial Sequence
  Synthetic Construct
ccttgccttgttcccatctttg

SEQ ID NO: 26517 - DNA, 22 bp, Artificial Sequence
  Synthetic Construct
ttctgggccctttcttgctatc

SEQ ID NO: 26518 - DNA, 21 bp, Artificial Sequence
  Synthetic Construct
ggacaaaacctgcacccattg

SEQ ID NO: 26519 - DNA, 22 bp, Artificial Sequence
  Synthetic Construct
gccagtacatgtcaggcactta

SEQ ID NO: 26520 - DNA, 21 bp, Artificial Sequence
  Synthetic Construct
agtgctgtgccattcaggaaa

SEQ ID NO: 26521 - DNA, 21 bp, Artificial Sequence
  Synthetic Construct
gcccagtgtggaaacatggaa

SEQ ID NO: 26522 - DNA, 26 bp, Artificial Sequence
  Synthetic Construct
ctgagagatgcagagacgatgagatg

SEQ ID NO: 26523 - DNA, 19 bp, Artificial Sequence
  Synthetic Construct
cccagacagccctgcacaa

SEQ ID NO: 26524 - DNA, 20 bp, Artificial Sequence
  Synthetic Construct
tggggcagtttcccagtagt

SEQ ID NO: 26525 - DNA, 20 bp, Artificial Sequence
  Synthetic Construct
ttggaagcgagcagccatac

SEQ ID NO: 26526 - DNA, 23 bp, Artificial Sequence
  Synthetic Construct
ccacctagtcctgggctctttag

SEQ ID NO: 26527 - DNA, 23 bp, Artificial Sequence
  Synthetic Construct
gccaggaagcaatctccgtaatc

SEQ ID NO: 26528 - DNA, 24 bp, Artificial Sequence
  Synthetic Construct
gcgcattatcaccactcagacttc

SEQ ID NO: 26529 - DNA, 19 bp, Artificial Sequence
  Synthetic Construct
gccgtccaggcagtagttc

SEQ ID NO: 26530 - DNA, 20 bp, Artificial Sequence
  Synthetic Construct
gctgctagactgcgggtttc

SEQ ID NO: 26531 - DNA, 19 bp, Artificial Sequence
  Synthetic Construct
tgcatcgcccctccaccaa

SEQ ID NO: 26532 - DNA, 22 bp, Artificial Sequence
  Synthetic Construct
actctgagtggaggtggccttt

SEQ ID NO: 26533 - DNA, 23 bp, Artificial Sequence
  Synthetic Construct
ctccccaccaccactgagaataa

SEQ ID NO: 26534 - DNA, 24 bp, Artificial Sequence
  Synthetic Construct
gtagactgctggggtttagagact

SEQ ID NO: 26535 - DNA, 22 bp, Artificial Sequence
  Synthetic Construct
ggctcaccagtgttaccaggat

SEQ ID NO: 26536 - DNA, 18 bp, Artificial Sequence
  Synthetic Construct
agggcctgtgagggttga

SEQ ID NO: 26537 - DNA, 21 bp, Artificial Sequence
  Synthetic Construct
ggtggagtcagtggagccaaa

SEQ ID NO: 26538 - DNA, 21 bp, Artificial Sequence
  Synthetic Construct
cggccaaagaggtttcgttct

SEQ ID NO: 26539 - DNA, 20 bp, Artificial Sequence
  Synthetic Construct
gtggcccttgctgaccatta

SEQ ID NO: 26540 - DNA, 25 bp, Artificial Sequence
  Synthetic Construct
cttccaccaagagatacaacagtga

SEQ ID NO: 26541 - DNA, 20 bp, Artificial Sequence
  Synthetic Construct
attctgggctgggtcccaaa

SEQ ID NO: 26542 - DNA, 26 bp, Artificial Sequence
  Synthetic Construct
cttttccccttcccatcatctgattc

SEQ ID NO: 26543 - DNA, 24 bp, Artificial Sequence
  Synthetic Construct
cacatggtagcagggattgcaaga

SEQ ID NO: 26544 - DNA, 21 bp, Artificial Sequence
  Synthetic Construct
ggggtgtccacctcgcttatg

SEQ ID NO: 26545 - DNA, 21 bp, Artificial Sequence
  Synthetic Construct
ctggcagcaagaatccacctt

SEQ ID NO: 26546 - DNA, 22 bp, Artificial Sequence
  Synthetic Construct
ccatcccacttgaccccaatca

SEQ ID NO: 26547 - DNA, 20 bp, Artificial Sequence
  Synthetic Construct
acgtgccaagcacccaacaa

SEQ ID NO: 26548 - DNA, 19 bp, Artificial Sequence
  Synthetic Construct
cagaaccggaggcaacagt

SEQ ID NO: 26549 - DNA, 24 bp, Artificial Sequence
  Synthetic Construct
aggcacaactacctactcacaaag

SEQ ID NO: 26550 - DNA, 23 bp, Artificial Sequence
  Synthetic Construct
ccagagcaaactcaggtgacaac

SEQ ID NO: 26551 - DNA, 27 bp, Artificial Sequence
  Synthetic Construct
gggattacaggctacttttctagtctt

SEQ ID NO: 26552 - DNA, 22 bp, Artificial Sequence
  Synthetic Construct
gtaaccactccctggctactgt

SEQ ID NO: 26553 - DNA, 22 bp, Artificial Sequence
  Synthetic Construct
ctctgagctcttgcgtttctga

SEQ ID NO: 26554 - DNA, 23 bp, Artificial Sequence
  Synthetic Construct
tgtgctctcagcactttttgtga

SEQ ID NO: 26555 - DNA, 20 bp, Artificial Sequence
  Synthetic Construct
acctccaggcttgtgctact

SEQ ID NO: 26556 - DNA, 23 bp, Artificial Sequence
  Synthetic Construct
acggtggaggctaaacaaaacat

SEQ ID NO: 26557 - DNA, 22 bp, Artificial Sequence
  Synthetic Construct
ggtctgaccaccctactgaaga

SEQ ID NO: 26558 - DNA, 24 bp, Artificial Sequence
  Synthetic Construct
gacaatgtcccctgactggaattt

SEQ ID NO: 26559 - DNA, 22 bp, Artificial Sequence
  Synthetic Construct
cctcagggagcttgtagtctct

SEQ ID NO: 26560 - DNA, 24 bp, Artificial Sequence
  Synthetic Construct
ggggttaagctttcaggagctaag

SEQ ID NO: 26561 - DNA, 22 bp, Artificial Sequence
  Synthetic Construct
gggcttcagctggaagttgttg

SEQ ID NO: 26562 - DNA, 23 bp, Artificial Sequence
  Synthetic Construct
gccccaaatttgcaatgcagtag

SEQ ID NO: 26563 - DNA, 24 bp, Artificial Sequence
  Synthetic Construct
ctctacggaaatatgggcctgatg

SEQ ID NO: 26564 - DNA, 20 bp, Artificial Sequence
  Synthetic Construct
ggaagccaagcagtgacagt

SEQ ID NO: 26565 - DNA, 24 bp, Artificial Sequence
  Synthetic Construct
gtgtgatccagagcaagtcttcta

SEQ ID NO: 26566 - DNA, 20 bp, Artificial Sequence
  Synthetic Construct
ctgcatcccacgttggcttt

SEQ ID NO: 26567 - DNA, 24 bp, Artificial Sequence
  Synthetic Construct
ccacagaaccagagggacttgaac

SEQ ID NO: 26568 - DNA, 25 bp, Artificial Sequence
  Synthetic Construct
ccaagcagggattagaaaagtctga

SEQ ID NO: 26569 - DNA, 22 bp, Artificial Sequence
  Synthetic Construct
aggctagacctaggctttggat

SEQ ID NO: 26570 - DNA, 21 bp, Artificial Sequence
  Synthetic Construct
gcccagggaaatcctctctgt

SEQ ID NO: 26571 - DNA, 20 bp, Artificial Sequence
  Synthetic Construct
catgtcaagggcctgtcagt

SEQ ID NO: 26572 - DNA, 20 bp, Artificial Sequence
  Synthetic Construct
cccacaagccaagccaacaa

SEQ ID NO: 26573 - DNA, 23 bp, Artificial Sequence
  Synthetic Construct
cgatttttgcctcctggaacgaa

SEQ ID NO: 26574 - DNA, 22 bp, Artificial Sequence
  Synthetic Construct
gagttgggtgtggggtgatgta

SEQ ID NO: 26575 - DNA, 23 bp, Artificial Sequence
  Synthetic Construct
gaaagaccagctgttccatccaa

SEQ ID NO: 26576 - DNA, 24 bp, Artificial Sequence
  Synthetic Construct
agagtgtgggataatggtggaaga

SEQ ID NO: 26577 - DNA, 24 bp, Artificial Sequence
  Synthetic Construct
caggttctcacattgggactgact

SEQ ID NO: 26578 - DNA, 23 bp, Artificial Sequence
  Synthetic Construct
acaggagtgttccagctaacatc

SEQ ID NO: 26579 - DNA, 24 bp, Artificial Sequence
  Synthetic Construct
gcgcccagccagatttctgaatta

SEQ ID NO: 26580 - DNA, 22 bp, Artificial Sequence
  Synthetic Construct
ggaaaacatgcccacccgagaa

SEQ ID NO: 26581 - DNA, 24 bp, Artificial Sequence
  Synthetic Construct
gtccactcacaggtggagatgagt

SEQ ID NO: 26582 - DNA, 21 bp, Artificial Sequence
  Synthetic Construct
tgccatccgctttgtttccta

SEQ ID NO: 26583 - DNA, 20 bp, Artificial Sequence
  Synthetic Construct
caggcaggtggaggaactca

SEQ ID NO: 26584 - DNA, 20 bp, Artificial Sequence
  Synthetic Construct
ttcgccagccacgaggaaat

SEQ ID NO: 26585 - DNA, 19 bp, Artificial Sequence
  Synthetic Construct
gccccagcttggacagatg

SEQ ID NO: 26586 - DNA, 23 bp, Artificial Sequence
  Synthetic Construct
gaaggaggccctagggaggattt

SEQ ID NO: 26587 - DNA, 20 bp, Artificial Sequence
  Synthetic Construct
tcactcagactggggtgcaa

SEQ ID NO: 26588 - DNA, 22 bp, Artificial Sequence
  Synthetic Construct
ggtccgctgacctctcaatctt

SEQ ID NO: 26589 - DNA, 21 bp, Artificial Sequence
  Synthetic Construct
aggaactggaagccgctctct

SEQ ID NO: 26590 - DNA, 20 bp, Artificial Sequence
  Synthetic Construct
gcacagtgagccactcttct

SEQ ID NO: 26591 - DNA, 22 bp, Artificial Sequence
  Synthetic Construct
gggtggaggggtgtctaaaatg

SEQ ID NO: 26592 - DNA, 23 bp, Artificial Sequence
  Synthetic Construct
gagtctacacgggtgtgagtaag

SEQ ID NO: 26593 - DNA, 23 bp, Artificial Sequence
  Synthetic Construct
agggttagtgcggtaaatcaagt

SEQ ID NO: 26594 - DNA, 20 bp, Artificial Sequence
  Synthetic Construct
ccgctgttgccttcggtgat

SEQ ID NO: 26595 - DNA, 22 bp, Artificial Sequence
  Synthetic Construct
gtgggaagaggctgactttcaa

SEQ ID NO: 26596 - DNA, 21 bp, Artificial Sequence
  Synthetic Construct
gcccagtgcctcacacttgta

SEQ ID NO: 26597 - DNA, 21 bp, Artificial Sequence
  Synthetic Construct
aggcgggtgtctgtggaagat

SEQ ID NO: 26598 - DNA, 23 bp, Artificial Sequence
  Synthetic Construct
tgccagctcagtatgtggaaatg

SEQ ID NO: 26599 - DNA, 27 bp, Artificial Sequence
  Synthetic Construct
gtgcatctaatgaccaggagaagtcaa

SEQ ID NO: 26600 - DNA, 22 bp, Artificial Sequence
  Synthetic Construct
tccccgcaaattctttcctctt

SEQ ID NO: 26601 - DNA, 20 bp, Artificial Sequence
  Synthetic Construct
actggggctccagaatgtca

SEQ ID NO: 26602 - DNA, 20 bp, Artificial Sequence
  Synthetic Construct
ggctgtgcatctgcatctct

SEQ ID NO: 26603 - DNA, 23 bp, Artificial Sequence
  Synthetic Construct
agccccttacgagaagggcttag

SEQ ID NO: 26604 - DNA, 21 bp, Artificial Sequence
  Synthetic Construct
tcggggttactggcagagcaa

SEQ ID NO: 26605 - DNA, 20 bp, Artificial Sequence
  Synthetic Construct
acccgaacaagctggcatca

SEQ ID NO: 26606 - DNA, 26 bp, Artificial Sequence
  Synthetic Construct
gggagctctatcctagggagttatag

SEQ ID NO: 26607 - DNA, 21 bp, Artificial Sequence
  Synthetic Construct
ccgcgagaaagagaagagtca

SEQ ID NO: 26608 - DNA, 22 bp, Artificial Sequence
  Synthetic Construct
gggttcagtcgggaaagtcaca

SEQ ID NO: 26609 - DNA, 22 bp, Artificial Sequence
  Synthetic Construct
ctgggctttgaccagtgaggat

SEQ ID NO: 26610 - DNA, 23 bp, Artificial Sequence
  Synthetic Construct
cacaccttttcccaggagctcta

SEQ ID NO: 26611 - DNA, 25 bp, Artificial Sequence
  Synthetic Construct
ggtccagagtgtgtctaaaatgtca

SEQ ID NO: 26612 - DNA, 20 bp, Artificial Sequence
  Synthetic Construct
cgtggaaatggcagccttca

SEQ ID NO: 26613 - DNA, 22 bp, Artificial Sequence
  Synthetic Construct
tccatgcttagcacgccttaaa

SEQ ID NO: 26614 - DNA, 22 bp, Artificial Sequence
  Synthetic Construct
gagcccaaaagtctggcactac

SEQ ID NO: 26615 - DNA, 19 bp, Artificial Sequence
  Synthetic Construct
ggccggccacagtgagaaa

SEQ ID NO: 26616 - DNA, 20 bp, Artificial Sequence
  Synthetic Construct
tggggcattgggatcctttg

SEQ ID NO: 26617 - DNA, 24 bp, Artificial Sequence
  Synthetic Construct
aggtcgctgaagaatggtagattt

SEQ ID NO: 26618 - DNA, 23 bp, Artificial Sequence
  Synthetic Construct
actactgtcacccgagtctttct

SEQ ID NO: 26619 - DNA, 21 bp, Artificial Sequence
  Synthetic Construct
aaacgcaggctggctctggat

SEQ ID NO: 26620 - DNA, 24 bp, Artificial Sequence
  Synthetic Construct
gaagtgcaatggggagaaaagaga

SEQ ID NO: 26621 - DNA, 23 bp, Artificial Sequence
  Synthetic Construct
ccttggcccagttatgttcttga

SEQ ID NO: 26622 - DNA, 20 bp, Artificial Sequence
  Synthetic Construct
ccccaagtgctgatggtgtt

SEQ ID NO: 26623 - DNA, 21 bp, Artificial Sequence
  Synthetic Construct
atgcctagcacagggtagact

SEQ ID NO: 26624 - DNA, 22 bp, Artificial Sequence
  Synthetic Construct
ccccagtaagctgtgactgaac

SEQ ID NO: 26625 - DNA, 23 bp, Artificial Sequence
  Synthetic Construct
gagggaccctagatccagaggaa

SEQ ID NO: 26626 - DNA, 18 bp, Artificial Sequence
  Synthetic Construct
tggcccacagctccacat

SEQ ID NO: 26627 - DNA, 21 bp, Artificial Sequence
  Synthetic Construct
caaaggtgcaccaggctctct

SEQ ID NO: 26628 - DNA, 21 bp, Artificial Sequence
  Synthetic Construct
gcgctggctacaatccgtgaa

SEQ ID NO: 26629 - DNA, 22 bp, Artificial Sequence
  Synthetic Construct
acttccctcagccctacctcta

SEQ ID NO: 26630 - DNA, 23 bp, Artificial Sequence
  Synthetic Construct
ggaagggtgtcctcagaccacat

SEQ ID NO: 26631 - DNA, 24 bp, Artificial Sequence
  Synthetic Construct
cctcctctcacctcctactctttt

SEQ ID NO: 26632 - DNA, 24 bp, Artificial Sequence
  Synthetic Construct
acatctgtccatcctttggagttt

SEQ ID NO: 26633 - DNA, 22 bp, Artificial Sequence
  Synthetic Construct
ggggtggtcaacctgagaacat

SEQ ID NO: 26634 - DNA, 27 bp, Artificial Sequence
  Synthetic Construct
actaacactttatctcctcagcctaga

SEQ ID NO: 26635 - DNA, 22 bp, Artificial Sequence
  Synthetic Construct
accaacctacagcgacagaaag

SEQ ID NO: 26636 - DNA, 22 bp, Artificial Sequence
  Synthetic Construct
gtgctgggtgctgaaggtaaag

SEQ ID NO: 26637 - DNA, 24 bp, Artificial Sequence
  Synthetic Construct
ctgggaaattgcccctctatttct

SEQ ID NO: 26638 - DNA, 22 bp, Artificial Sequence
  Synthetic Construct
gctctgaaattgtcccctgcaa

SEQ ID NO: 26639 - DNA, 22 bp, Artificial Sequence
  Synthetic Construct
agtagggagccatggtagtgaa

SEQ ID NO: 26640 - DNA, 22 bp, Artificial Sequence
  Synthetic Construct
cagcccgaggacacattagtca

SEQ ID NO: 26641 - DNA, 25 bp, Artificial Sequence
  Synthetic Construct
gtctccaatgccttccgaaatgtgt

SEQ ID NO: 26642 - DNA, 23 bp, Artificial Sequence
  Synthetic Construct
aagaagagccacactgagttgtt

SEQ ID NO: 26643 - DNA, 26 bp, Artificial Sequence
  Synthetic Construct
caggagcctattcattttccccagaa

SEQ ID NO: 26644 - DNA, 24 bp, Artificial Sequence
  Synthetic Construct
tcctgttgtggttcgatggtttag

SEQ ID NO: 26645 - DNA, 20 bp, Artificial Sequence
  Synthetic Construct
gctggcgggaagtcacacaa

SEQ ID NO: 26646 - DNA, 24 bp, Artificial Sequence
  Synthetic Construct
ccacaaaagaagatacccctgctt

SEQ ID NO: 26647 - DNA, 19 bp, Artificial Sequence
  Synthetic Construct
ggctttcctcgtggcttga

SEQ ID NO: 26648 - DNA, 24 bp, Artificial Sequence
  Synthetic Construct
gtcccagtttcaccctgaaggatt

SEQ ID NO: 26649 - DNA, 23 bp, Artificial Sequence
  Synthetic Construct
cctgggaaaggtgagatcagaca

SEQ ID NO: 26650 - DNA, 22 bp, Artificial Sequence
  Synthetic Construct
gagcaattggctggcaatgagt

SEQ ID NO: 26651 - DNA, 20 bp, Artificial Sequence
  Synthetic Construct
agcaccaccaaaaggcaact

SEQ ID NO: 26652 - DNA, 20 bp, Artificial Sequence
  Synthetic Construct
aatgcaccctctccctgctt

SEQ ID NO: 26653 - DNA, 20 bp, Artificial Sequence
  Synthetic Construct
catgggtgcacctgttctca

SEQ ID NO: 26654 - DNA, 20 bp, Artificial Sequence
  Synthetic Construct
acctgggcctgcctgtatga

SEQ ID NO: 26655 - DNA, 20 bp, Artificial Sequence
  Synthetic Construct
tcaggcccactccccggtta

SEQ ID NO: 26656 - DNA, 22 bp, Artificial Sequence
  Synthetic Construct
tgctgtgggaagcatgagtaac

SEQ ID NO: 26657 - DNA, 21 bp, Artificial Sequence
  Synthetic Construct
gctggagctggtagcaacact

SEQ ID NO: 26658 - DNA, 23 bp, Artificial Sequence
  Synthetic Construct
gcaagtctgcttgcagaaagaaa

SEQ ID NO: 26659 - DNA, 24 bp, Artificial Sequence
  Synthetic Construct
aagcagtgagtttgcttgtgatac

SEQ ID NO: 26660 - DNA, 19 bp, Artificial Sequence
  Synthetic Construct
gggcggcccttcgttcaaa

SEQ ID NO: 26661 - DNA, 24 bp, Artificial Sequence
  Synthetic Construct
gggatagactgagggtcagggaaa

SEQ ID NO: 26662 - DNA, 22 bp, Artificial Sequence
  Synthetic Construct
agggaagagcccagagacatca

SEQ ID NO: 26663 - DNA, 19 bp, Artificial Sequence
  Synthetic Construct
ccttcggccttggctctac

SEQ ID NO: 26664 - DNA, 22 bp, Artificial Sequence
  Synthetic Construct
ggggtgggacacatggaaatca

SEQ ID NO: 26665 - DNA, 23 bp, Artificial Sequence
  Synthetic Construct
ccacagctatgcccttcttctct

SEQ ID NO: 26666 - DNA, 21 bp, Artificial Sequence
  Synthetic Construct
gtctccagtgctgtggtgaag

SEQ ID NO: 26667 - DNA, 20 bp, Artificial Sequence
  Synthetic Construct
tgtggcaacggcgaactgat

SEQ ID NO: 26668 - DNA, 21 bp, Artificial Sequence
  Synthetic Construct
agagagcgtcacctgcttatg

SEQ ID NO: 26669 - DNA, 22 bp, Artificial Sequence
  Synthetic Construct
gcacgtgcaccaggaacaacaa

SEQ ID NO: 26670 - DNA, 21 bp, Artificial Sequence
  Synthetic Construct
ccaggagtcagatggccgatt

SEQ ID NO: 26671 - DNA, 22 bp, Artificial Sequence
  Synthetic Construct
cccactcggaagaacaggttac

SEQ ID NO: 26672 - DNA, 24 bp, Artificial Sequence
  Synthetic Construct
gctagagaagagctcccattgttc

SEQ ID NO: 26673 - DNA, 23 bp, Artificial Sequence
  Synthetic Construct
cttcctaacagctgggtgaatga

SEQ ID NO: 26674 - DNA, 23 bp, Artificial Sequence
  Synthetic Construct
ggtctactgcgtgtgtttagttg

SEQ ID NO: 26675 - DNA, 24 bp, Artificial Sequence
  Synthetic Construct
gcttacccaggtagatgctctagt

SEQ ID NO: 26676 - DNA, 20 bp, Artificial Sequence
  Synthetic Construct
aggctgccatgcaagtcttc

SEQ ID NO: 26677 - DNA, 20 bp, Artificial Sequence
  Synthetic Construct
cgtgcaacactgccttcctt

SEQ ID NO: 26678 - DNA, 23 bp, Artificial Sequence
  Synthetic Construct
ccactgtacacaaagaggacgat

SEQ ID NO: 26679 - DNA, 25 bp, Artificial Sequence
  Synthetic Construct
tttggtcttcccggagatagttatg

SEQ ID NO: 26680 - DNA, 18 bp, Artificial Sequence
  Synthetic Construct
acgtgcagaaggcagcaa

SEQ ID NO: 26681 - DNA, 21 bp, Artificial Sequence
  Synthetic Construct
gtaccccagccattgtgacat

SEQ ID NO: 26682 - DNA, 22 bp, Artificial Sequence
  Synthetic Construct
tgtccctcctctgcactgctat

SEQ ID NO: 26683 - DNA, 27 bp, Artificial Sequence
  Synthetic Construct
ctgaagacagagttctcaagacacctt

SEQ ID NO: 26684 - DNA, 26 bp, Artificial Sequence
  Synthetic Construct
cagagtgtgttggggaaagtttggta

SEQ ID NO: 26685 - DNA, 20 bp, Artificial Sequence
  Synthetic Construct
gcctgagcctccctttctca

SEQ ID NO: 26686 - DNA, 21 bp, Artificial Sequence
  Synthetic Construct
tgtgtcctggggacattgaca

SEQ ID NO: 26687 - DNA, 23 bp, Artificial Sequence
  Synthetic Construct
gatgaagggccctgattttccat

SEQ ID NO: 26688 - DNA, 19 bp, Artificial Sequence
  Synthetic Construct
attgggctgcccggtgtta

SEQ ID NO: 26689 - DNA, 24 bp, Artificial Sequence
  Synthetic Construct
gacctagcaactcttgaggaaaca

SEQ ID NO: 26690 - DNA, 21 bp, Artificial Sequence
  Synthetic Construct
cagccgagctcacacttgtct

SEQ ID NO: 26691 - DNA, 22 bp, Artificial Sequence
  Synthetic Construct
gccatggaagggaacagtccaa

SEQ ID NO: 26692 - DNA, 23 bp, Artificial Sequence
  Synthetic Construct
cttgcaggataagaccaccatgt

SEQ ID NO: 26693 - DNA, 21 bp, Artificial Sequence
  Synthetic Construct
gcgaggttccccttgatgctt

SEQ ID NO: 26694 - DNA, 22 bp, Artificial Sequence
  Synthetic Construct
ccttcctccctgctggtttgta

SEQ ID NO: 26695 - DNA, 25 bp, Artificial Sequence
  Synthetic Construct
gtcttgaactccttgttgaggatca

SEQ ID NO: 26696 - DNA, 20 bp, Artificial Sequence
  Synthetic Construct
ttcccggtggggctctcttc

SEQ ID NO: 26697 - DNA, 20 bp, Artificial Sequence
  Synthetic Construct
ccctgcccctcctctcatgt

SEQ ID NO: 26698 - DNA, 23 bp, Artificial Sequence
  Synthetic Construct
aaaaagctgtggctctcttctct

SEQ ID NO: 26699 - DNA, 25 bp, Artificial Sequence
  Synthetic Construct
ctgggaaaaataaggctgggaatca

SEQ ID NO: 26700 - DNA, 22 bp, Artificial Sequence
  Synthetic Construct
tgagggccaccaagctaggaaa

SEQ ID NO: 26701 - DNA, 22 bp, Artificial Sequence
  Synthetic Construct
tgaaatgccctcctcttggttt

SEQ ID NO: 26702 - DNA, 26 bp, Artificial Sequence
  Synthetic Construct
cttgtatgccagtctacatctgtttc

SEQ ID NO: 26703 - DNA, 23 bp, Artificial Sequence
  Synthetic Construct
cccagcctaaaatccctgagcta

SEQ ID NO: 26704 - DNA, 23 bp, Artificial Sequence
  Synthetic Construct
ccctgagaaccctggaagctact

SEQ ID NO: 26705 - DNA, 22 bp, Artificial Sequence
  Synthetic Construct
cgcccctgcctaaatggaaatg

SEQ ID NO: 26706 - DNA, 24 bp, Artificial Sequence
  Synthetic Construct
tgagggaggatcagtaaaccatgt

SEQ ID NO: 26707 - DNA, 22 bp, Artificial Sequence
  Synthetic Construct
cgcccagcctgacttgaatctt

SEQ ID NO: 26708 - DNA, 22 bp, Artificial Sequence
  Synthetic Construct
gggacctgacgcacgacaataa

SEQ ID NO: 26709 - DNA, 22 bp, Artificial Sequence
  Synthetic Construct
acctccaggctccaggaatttg

SEQ ID NO: 26710 - DNA, 22 bp, Artificial Sequence
  Synthetic Construct
gctgacagatttgtccctctgt

SEQ ID NO: 26711 - DNA, 22 bp, Artificial Sequence
  Synthetic Construct
gtaacgtttgcctggtccatct

SEQ ID NO: 26712 - DNA, 19 bp, Artificial Sequence
  Synthetic Construct
tgccctccacctggctttc

SEQ ID NO: 26713 - DNA, 23 bp, Artificial Sequence
  Synthetic Construct
agagtggaattaccagggagtct

SEQ ID NO: 26714 - DNA, 20 bp, Artificial Sequence
  Synthetic Construct
gcagggtccggccctaatga

SEQ ID NO: 26715 - DNA, 24 bp, Artificial Sequence
  Synthetic Construct
gccttcctctaccagggttctact

SEQ ID NO: 26716 - DNA, 20 bp, Artificial Sequence
  Synthetic Construct
ctgtggtcggattcgtggaa

SEQ ID NO: 26717 - DNA, 22 bp, Artificial Sequence
  Synthetic Construct
agtggccagggaggaagaacta

SEQ ID NO: 26718 - DNA, 19 bp, Artificial Sequence
  Synthetic Construct
cgtgacctccacccctagt

SEQ ID NO: 26719 - DNA, 21 bp, Artificial Sequence
  Synthetic Construct
tgttgggtccagccagtctca

SEQ ID NO: 26720 - DNA, 22 bp, Artificial Sequence
  Synthetic Construct
cctgctgtgtgcagtggttgaa

SEQ ID NO: 26721 - DNA, 24 bp, Artificial Sequence
  Synthetic Construct
tgtgaaaatccctgttgctcttca

SEQ ID NO: 26722 - DNA, 24 bp, Artificial Sequence
  Synthetic Construct
gagaagagaggtgataggggacat

SEQ ID NO: 26723 - DNA, 21 bp, Artificial Sequence
  Synthetic Construct
gcgcttgcccatagaaagtga

SEQ ID NO: 26724 - DNA, 23 bp, Artificial Sequence
  Synthetic Construct
tggacgaccttttgccatttttg

SEQ ID NO: 26725 - DNA, 20 bp, Artificial Sequence
  Synthetic Construct
aggcagcagagaggtccaaa

SEQ ID NO: 26726 - DNA, 25 bp, Artificial Sequence
  Synthetic Construct
gggcttgaacctcagctctatcatc

SEQ ID NO: 26727 - DNA, 24 bp, Artificial Sequence
  Synthetic Construct
ctgaccagagagattgggccttct

SEQ ID NO: 26728 - DNA, 23 bp, Artificial Sequence
  Synthetic Construct
actgttcagctaacggtgtcaag

SEQ ID NO: 26729 - DNA, 22 bp, Artificial Sequence
  Synthetic Construct
gaaagcctgagaaggtgccaat

SEQ ID NO: 26730 - DNA, 19 bp, Artificial Sequence
  Synthetic Construct
cgacgggcagctgtcaaga

SEQ ID NO: 26731 - DNA, 22 bp, Artificial Sequence
  Synthetic Construct
tgcctccttttctcagggtctt

SEQ ID NO: 26732 - DNA, 24 bp, Artificial Sequence
  Synthetic Construct
gccttgaatgtcaggcgaaataac

SEQ ID NO: 26733 - DNA, 20 bp, Artificial Sequence
  Synthetic Construct
aagaatgccctgcactgtgt

SEQ ID NO: 26734 - DNA, 23 bp, Artificial Sequence
  Synthetic Construct
gggagaggtatgccaggctctaa

SEQ ID NO: 26735 - DNA, 23 bp, Artificial Sequence
  Synthetic Construct
tgactgttgtccctgtcagtttg

SEQ ID NO: 26736 - DNA, 22 bp, Artificial Sequence
  Synthetic Construct
acaggtcccttgggcccttatt

SEQ ID NO: 26737 - DNA, 19 bp, Artificial Sequence
  Synthetic Construct
aggcagcccctgctcactt

SEQ ID NO: 26738 - DNA, 20 bp, Artificial Sequence
  Synthetic Construct
cacggacgtgcatgacacta

SEQ ID NO: 26739 - DNA, 23 bp, Artificial Sequence
  Synthetic Construct
caggagcaggggtgtattgaaag

SEQ ID NO: 26740 - DNA, 20 bp, Artificial Sequence
  Synthetic Construct
tcacccacagccatctcaca

SEQ ID NO: 26741 - DNA, 22 bp, Artificial Sequence
  Synthetic Construct
agggctgtctcctctcctgttt

SEQ ID NO: 26742 - DNA, 22 bp, Artificial Sequence
  Synthetic Construct
ctgccccaccatatctgagaag

SEQ ID NO: 26743 - DNA, 25 bp, Artificial Sequence
  Synthetic Construct
tctttaccgcatggttctaacacaa

SEQ ID NO: 26744 - DNA, 22 bp, Artificial Sequence
  Synthetic Construct
cagccttccacgatggagaaac

SEQ ID NO: 26745 - DNA, 24 bp, Artificial Sequence
  Synthetic Construct
gataccacaaacttggagcaaaca

SEQ ID NO: 26746 - DNA, 22 bp, Artificial Sequence
  Synthetic Construct
gctggaaccacagagacgaaca

SEQ ID NO: 26747 - DNA, 24 bp, Artificial Sequence
  Synthetic Construct
gagctactggagtccaaatcactt

SEQ ID NO: 26748 - DNA, 24 bp, Artificial Sequence
  Synthetic Construct
gcatggtgcacaggtgcatattct

SEQ ID NO: 26749 - DNA, 22 bp, Artificial Sequence
  Synthetic Construct
ggccatctagggtggtgaacaa

SEQ ID NO: 26750 - DNA, 26 bp, Artificial Sequence
  Synthetic Construct
gtaaacattcaccaggagcttccata

SEQ ID NO: 26751 - DNA, 25 bp, Artificial Sequence
  Synthetic Construct
gggttatgaagactggcttcgacat

SEQ ID NO: 26752 - DNA, 22 bp, Artificial Sequence
  Synthetic Construct
tccagaaaaatggagccacaca

SEQ ID NO: 26753 - DNA, 23 bp, Artificial Sequence
  Synthetic Construct
gacatcagggtgctgtcttctca

SEQ ID NO: 26754 - DNA, 20 bp, Artificial Sequence
  Synthetic Construct
agtgtgcgtcaggactgaga

SEQ ID NO: 26755 - DNA, 21 bp, Artificial Sequence
  Synthetic Construct
ttcgggaccgtttccccaaca

SEQ ID NO: 26756 - DNA, 25 bp, Artificial Sequence
  Synthetic Construct
gatgacaccttctatgtcctcaagt

SEQ ID NO: 26757 - DNA, 25 bp, Artificial Sequence
  Synthetic Construct
tgacctggacacacaggatatatga

SEQ ID NO: 26758 - DNA, 22 bp, Artificial Sequence
  Synthetic Construct
tgaaagcccaccttcattgtca

SEQ ID NO: 26759 - DNA, 20 bp, Artificial Sequence
  Synthetic Construct
ggcccagcactacgtcaact

SEQ ID NO: 26760 - DNA, 22 bp, Artificial Sequence
  Synthetic Construct
gacccaaggggagtttgcattc

SEQ ID NO: 26761 - DNA, 22 bp, Artificial Sequence
  Synthetic Construct
ccaccaggtctcccttttgtga

SEQ ID NO: 26762 - DNA, 22 bp, Artificial Sequence
  Synthetic Construct
cacctctcccctcccagaacat

SEQ ID NO: 26763 - DNA, 26 bp, Artificial Sequence
  Synthetic Construct
cacccttcaagacccagtacgagtaa

SEQ ID NO: 26764 - DNA, 26 bp, Artificial Sequence
  Synthetic Construct
ggtgtcccctgaacaatgtctgtttc

SEQ ID NO: 26765 - DNA, 18 bp, Artificial Sequence
  Synthetic Construct
agcacccctggagcttgt

SEQ ID NO: 26766 - DNA, 21 bp, Artificial Sequence
  Synthetic Construct
atgcagaggcggaggcagata

SEQ ID NO: 26767 - DNA, 23 bp, Artificial Sequence
  Synthetic Construct
cctagaaaccctgagcagcaaca

SEQ ID NO: 26768 - DNA, 22 bp, Artificial Sequence
  Synthetic Construct
ttcctggagtgagccagtctgt

SEQ ID NO: 26769 - DNA, 22 bp, Artificial Sequence
  Synthetic Construct
gacaagcatctcgaagggcata

SEQ ID NO: 26770 - DNA, 24 bp, Artificial Sequence
  Synthetic Construct
caatttccaggaggccatgatact

SEQ ID NO: 26771 - DNA, 21 bp, Artificial Sequence
  Synthetic Construct
gggtgaagtgggtgcatctaa

SEQ ID NO: 26772 - DNA, 22 bp, Artificial Sequence
  Synthetic Construct
gcaggtcgtgcctcggtttatt

SEQ ID NO: 26773 - DNA, 24 bp, Artificial Sequence
  Synthetic Construct
gccctgcaggaacatttattgtct

SEQ ID NO: 26774 - DNA, 24 bp, Artificial Sequence
  Synthetic Construct
gtctcctagtacctgtgggtccat

SEQ ID NO: 26775 - DNA, 21 bp, Artificial Sequence
  Synthetic Construct
agtggggatcgtacagctctt

SEQ ID NO: 26776 - DNA, 20 bp, Artificial Sequence
  Synthetic Construct
tggccacccaggagtgatac

SEQ ID NO: 26777 - DNA, 24 bp, Artificial Sequence
  Synthetic Construct
agacgtgggtaggtaagtatggaa

SEQ ID NO: 26778 - DNA, 23 bp, Artificial Sequence
  Synthetic Construct
cagctgaaggaccttggtgagat

SEQ ID NO: 26779 - DNA, 22 bp, Artificial Sequence
  Synthetic Construct
tctcaggcttggtagcctatgt

SEQ ID NO: 26780 - DNA, 22 bp, Artificial Sequence
  Synthetic Construct
gccgaggaaggagacagtgaca

SEQ ID NO: 26781 - DNA, 20 bp, Artificial Sequence
  Synthetic Construct
ccccagcagcatttcagcaa

SEQ ID NO: 26782 - DNA, 21 bp, Artificial Sequence
  Synthetic Construct
ccactcccaccactgcacaat

SEQ ID NO: 26783 - DNA, 21 bp, Artificial Sequence
  Synthetic Construct
ggcaatacacacacggctcaa

SEQ ID NO: 26784 - DNA, 23 bp, Artificial Sequence
  Synthetic Construct
cctagggtgagccagttcctaga

SEQ ID NO: 26785 - DNA, 21 bp, Artificial Sequence
  Synthetic Construct
cctcacagctgagccatgaaa

SEQ ID NO: 26786 - DNA, 21 bp, Artificial Sequence
  Synthetic Construct
acagtactgggccagatggaa

SEQ ID NO: 26787 - DNA, 25 bp, Artificial Sequence
  Synthetic Construct
cactaagtctgggcatggactttac

SEQ ID NO: 26788 - DNA, 24 bp, Artificial Sequence
  Synthetic Construct
agtggaagagccttgagaagtttt

SEQ ID NO: 26789 - DNA, 20 bp, Artificial Sequence
  Synthetic Construct
acccagcctgcaggagaaag

SEQ ID NO: 26790 - DNA, 19 bp, Artificial Sequence
  Synthetic Construct
agcccagcccgagacattt

SEQ ID NO: 26791 - DNA, 23 bp, Artificial Sequence
  Synthetic Construct
ctggaccagccagtcaatggtta

SEQ ID NO: 26792 - DNA, 23 bp, Artificial Sequence
  Synthetic Construct
cgttgctcagttcctggaaagtt

SEQ ID NO: 26793 - DNA, 21 bp, Artificial Sequence
  Synthetic Construct
gcttccggatgtctacaccaa

SEQ ID NO: 26794 - DNA, 23 bp, Artificial Sequence
  Synthetic Construct
tcttcctaagcctggtaggagtt

SEQ ID NO: 26795 - DNA, 20 bp, Artificial Sequence
  Synthetic Construct
ttcccaaccctcgggacact

SEQ ID NO: 26796 - DNA, 20 bp, Artificial Sequence
  Synthetic Construct
ccaatcaggccagtgtcagt

SEQ ID NO: 26797 - DNA, 20 bp, Artificial Sequence
  Synthetic Construct
gagaggaaccggtgggacta

SEQ ID NO: 26798 - DNA, 22 bp, Artificial Sequence
  Synthetic Construct
ggaggctgaggtggaaggatct

SEQ ID NO: 26799 - DNA, 19 bp, Artificial Sequence
  Synthetic Construct
cagccaccaggagggtgaa

SEQ ID NO: 26800 - DNA, 20 bp, Artificial Sequence
  Synthetic Construct
ggccctccgtatccaaggtt

SEQ ID NO: 26801 - DNA, 24 bp, Artificial Sequence
  Synthetic Construct
ttgtataacacgctgcaggaaaag

SEQ ID NO: 26802 - DNA, 26 bp, Artificial Sequence
  Synthetic Construct
ctagtggcttgctcaattcctatttg

SEQ ID NO: 26803 - DNA, 23 bp, Artificial Sequence
  Synthetic Construct
gctggcttctccagtaacaatga

SEQ ID NO: 26804 - DNA, 25 bp, Artificial Sequence
  Synthetic Construct
tcctcacaagaaatggacaatggat

SEQ ID NO: 26805 - DNA, 22 bp, Artificial Sequence
  Synthetic Construct
cctggccgtgcctgatatttct

SEQ ID NO: 26806 - DNA, 23 bp, Artificial Sequence
  Synthetic Construct
aggagagacacagagggacattt

SEQ ID NO: 26807 - DNA, 24 bp, Artificial Sequence
  Synthetic Construct
gtttctctggccatttaggactca

SEQ ID NO: 26808 - DNA, 25 bp, Artificial Sequence
  Synthetic Construct
gacctttcttcctttctctcaccaa

SEQ ID NO: 26809 - DNA, 20 bp, Artificial Sequence
  Synthetic Construct
tagggtcctgtcccctctct

SEQ ID NO: 26810 - DNA, 27 bp, Artificial Sequence
  Synthetic Construct
cccaaagcagctaatgagcattgcata

SEQ ID NO: 26811 - DNA, 25 bp, Artificial Sequence
  Synthetic Construct
tgtgtgttaccaatgccaaacaatc

SEQ ID NO: 26812 - DNA, 23 bp, Artificial Sequence
  Synthetic Construct
tctcaagaaaacctgtggcaagt

SEQ ID NO: 26813 - DNA, 23 bp, Artificial Sequence
  Synthetic Construct
ggctgggagggccttcaaatatc

SEQ ID NO: 26814 - DNA, 25 bp, Artificial Sequence
  Synthetic Construct
gaaaccttgtttcctgcagatgatg

SEQ ID NO: 26815 - DNA, 23 bp, Artificial Sequence
  Synthetic Construct
ctgctgacctgactgtgagtgaa

SEQ ID NO: 26816 - DNA, 24 bp, Artificial Sequence
  Synthetic Construct
caggtccaccaacaaatcatcatc

SEQ ID NO: 26817 - DNA, 20 bp, Artificial Sequence
  Synthetic Construct
gcagacatgtgggtgacaga

SEQ ID NO: 26818 - DNA, 20 bp, Artificial Sequence
  Synthetic Construct
gctgcgggcagcattttaag

SEQ ID NO: 26819 - DNA, 21 bp, Artificial Sequence
  Synthetic Construct
caccctggagcctcaatccat

SEQ ID NO: 26820 - DNA, 18 bp, Artificial Sequence
  Synthetic Construct
agccttgcaggccctact

SEQ ID NO: 26821 - DNA, 23 bp, Artificial Sequence
  Synthetic Construct
acaagtgattctcatggccactt

SEQ ID NO: 26822 - DNA, 25 bp, Artificial Sequence
  Synthetic Construct
ccctcaaccatgtgcagaaaacttg

SEQ ID NO: 26823 - DNA, 22 bp, Artificial Sequence
  Synthetic Construct
ggggaagcagctttcactctct

SEQ ID NO: 26824 - DNA, 21 bp, Artificial Sequence
  Synthetic Construct
cgccagggaggctgttagaaa

SEQ ID NO: 26825 - DNA, 24 bp, Artificial Sequence
  Synthetic Construct
cctattgttcttggcccctttagt

SEQ ID NO: 26826 - DNA, 20 bp, Artificial Sequence
  Synthetic Construct
actgcattgtgcgtgaccat

SEQ ID NO: 26827 - DNA, 20 bp, Artificial Sequence
  Synthetic Construct
tcctgagcgtggtggagatg

SEQ ID NO: 26828 - DNA, 24 bp, Artificial Sequence
  Synthetic Construct
cacgtgaaatgaattgccttctgt

SEQ ID NO: 26829 - DNA, 21 bp, Artificial Sequence
  Synthetic Construct
ggagcagcagccatactccaa

SEQ ID NO: 26830 - DNA, 26 bp, Artificial Sequence
  Synthetic Construct
ctcatgactggttgtttctccttgaa

SEQ ID NO: 26831 - DNA, 20 bp, Artificial Sequence
  Synthetic Construct
tcctcctgctcctgggtcat

SEQ ID NO: 26832 - DNA, 22 bp, Artificial Sequence
  Synthetic Construct
tgtggtctctgagcctgctgtt

SEQ ID NO: 26833 - DNA, 22 bp, Artificial Sequence
  Synthetic Construct
catgtggctctagagggaggaa

SEQ ID NO: 26834 - DNA, 22 bp, Artificial Sequence
  Synthetic Construct
ggaggctgccagaagtcagaac

SEQ ID NO: 26835 - DNA, 26 bp, Artificial Sequence
  Synthetic Construct
gagttgtctctgcctttttggggata

SEQ ID NO: 26836 - DNA, 22 bp, Artificial Sequence
  Synthetic Construct
acttcccctgtaggcactgtca

SEQ ID NO: 26837 - DNA, 19 bp, Artificial Sequence
  Synthetic Construct
tagcgcgcgcgacaaacta

SEQ ID NO: 26838 - DNA, 23 bp, Artificial Sequence
  Synthetic Construct
gtccacaacgcattactgctcat

SEQ ID NO: 26839 - DNA, 22 bp, Artificial Sequence
  Synthetic Construct
gacctccagggtgcatgtcaaa

SEQ ID NO: 26840 - DNA, 20 bp, Artificial Sequence
  Synthetic Construct
tgctgccagccactttgtgt

SEQ ID NO: 26841 - DNA, 22 bp, Artificial Sequence
  Synthetic Construct
ctgcctccactgtgtcttctgt

SEQ ID NO: 26842 - DNA, 24 bp, Artificial Sequence
  Synthetic Construct
tctcatggttgggtaatgcaaaga

SEQ ID NO: 26843 - DNA, 22 bp, Artificial Sequence
  Synthetic Construct
gtgttggggcagaccttcagta

SEQ ID NO: 26844 - DNA, 20 bp, Artificial Sequence
  Synthetic Construct
ctccacctgccacactctct

SEQ ID NO: 26845 - DNA, 20 bp, Artificial Sequence
  Synthetic Construct
ggctcagggcccaaggatct

SEQ ID NO: 26846 - DNA, 22 bp, Artificial Sequence
  Synthetic Construct
gcctttattccctgccccaatc

SEQ ID NO: 26847 - DNA, 22 bp, Artificial Sequence
  Synthetic Construct
ctctgattctgcccctggaaca

SEQ ID NO: 26848 - DNA, 23 bp, Artificial Sequence
  Synthetic Construct
gcctgcactctcccacaactatg

SEQ ID NO: 26849 - DNA, 22 bp, Artificial Sequence
  Synthetic Construct
ctcccaccagcatccaaacaca

SEQ ID NO: 26850 - DNA, 21 bp, Artificial Sequence
  Synthetic Construct
cagcaagcaggctcaggtact

SEQ ID NO: 26851 - DNA, 26 bp, Artificial Sequence
  Synthetic Construct
gcatcagcatcactaacgaggtcttc

SEQ ID NO: 26852 - DNA, 24 bp, Artificial Sequence
  Synthetic Construct
ggtgtacaagaacgtctcagttgt

SEQ ID NO: 26853 - DNA, 18 bp, Artificial Sequence
  Synthetic Construct
gtcacaggggcacagctt

SEQ ID NO: 26854 - DNA, 21 bp, Artificial Sequence
  Synthetic Construct
ccaacgctcagccttcgtctt

SEQ ID NO: 26855 - DNA, 22 bp, Artificial Sequence
  Synthetic Construct
ccgtgtcttggcagaagctcta

SEQ ID NO: 26856 - DNA, 19 bp, Artificial Sequence
  Synthetic Construct
ggcacgagcctcggaagat

SEQ ID NO: 26857 - DNA, 20 bp, Artificial Sequence
  Synthetic Construct
gatggcgctgaatggagtct

SEQ ID NO: 26858 - DNA, 18 bp, Artificial Sequence
  Synthetic Construct
gcaagctcggggtggttt

SEQ ID NO: 26859 - DNA, 26 bp, Artificial Sequence
  Synthetic Construct
ggaatatacagacccttccttcaact

SEQ ID NO: 26860 - DNA, 21 bp, Artificial Sequence
  Synthetic Construct
tccctggcctccagtgatttg

SEQ ID NO: 26861 - DNA, 20 bp, Artificial Sequence
  Synthetic Construct
cccagaggtgcctgtgacat

SEQ ID NO: 26862 - DNA, 20 bp, Artificial Sequence
  Synthetic Construct
tcccgctgcgtgttagtttc

SEQ ID NO: 26863 - DNA, 21 bp, Artificial Sequence
  Synthetic Construct
gcaggaagccacacagaagtt

SEQ ID NO: 26864 - DNA, 20 bp, Artificial Sequence
  Synthetic Construct
tccgttgtgtgccaatgcta

SEQ ID NO: 26865 - DNA, 23 bp, Artificial Sequence
  Synthetic Construct
tggcagtttctgagtgggatttg

SEQ ID NO: 26866 - DNA, 21 bp, Artificial Sequence
  Synthetic Construct
cacagctccaggggcatcata

SEQ ID NO: 26867 - DNA, 22 bp, Artificial Sequence
  Synthetic Construct
agtgtacaggagtggcttcagt

SEQ ID NO: 26868 - DNA, 21 bp, Artificial Sequence
  Synthetic Construct
gcctcttcgggtccctgttct

SEQ ID NO: 26869 - DNA, 23 bp, Artificial Sequence
  Synthetic Construct
ctgaacaaggcgctgaaggaaga

SEQ ID NO: 26870 - DNA, 22 bp, Artificial Sequence
  Synthetic Construct
agtgcagagaatacccgagaca

SEQ ID NO: 26871 - DNA, 22 bp, Artificial Sequence
  Synthetic Construct
ggggctgacttatttggtggtt

SEQ ID NO: 26872 - DNA, 22 bp, Artificial Sequence
  Synthetic Construct
gcccaggtgaagcagaactttg

SEQ ID NO: 26873 - DNA, 25 bp, Artificial Sequence
  Synthetic Construct
ggactcacagaatgtgaccagatag

SEQ ID NO: 26874 - DNA, 22 bp, Artificial Sequence
  Synthetic Construct
gggaagccccactttaggagtt

SEQ ID NO: 26875 - DNA, 21 bp, Artificial Sequence
  Synthetic Construct
ccttttcctccccaggacttc

SEQ ID NO: 26876 - DNA, 22 bp, Artificial Sequence
  Synthetic Construct
aggcccatgtggctgatgttag

SEQ ID NO: 26877 - DNA, 23 bp, Artificial Sequence
  Synthetic Construct
gtcccctgtccataggagagact

SEQ ID NO: 26878 - DNA, 24 bp, Artificial Sequence
  Synthetic Construct
tgtgatctaccagcagccattatt

SEQ ID NO: 26879 - DNA, 19 bp, Artificial Sequence
  Synthetic Construct
gcacctgcgaaacgtggaa

SEQ ID NO: 26880 - DNA, 22 bp, Artificial Sequence
  Synthetic Construct
tgttacaggcagaagtgcaagt

SEQ ID NO: 26881 - DNA, 19 bp, Artificial Sequence
  Synthetic Construct
tggcacagcccacccgaaa

SEQ ID NO: 26882 - DNA, 25 bp, Artificial Sequence
  Synthetic Construct
ctctcccactaagttcaagttctgt

SEQ ID NO: 26883 - DNA, 21 bp, Artificial Sequence
  Synthetic Construct
tcagcagagcctgaagcaatg

SEQ ID NO: 26884 - DNA, 20 bp, Artificial Sequence
  Synthetic Construct
agcctcagagccgcatgaag

SEQ ID NO: 26885 - DNA, 19 bp, Artificial Sequence
  Synthetic Construct
gcctggcctgcactgagtt

SEQ ID NO: 26886 - DNA, 22 bp, Artificial Sequence
  Synthetic Construct
ggctataacaccctgctgacat

SEQ ID NO: 26887 - DNA, 21 bp, Artificial Sequence
  Synthetic Construct
caaacagggcacgtcccaaag

SEQ ID NO: 26888 - DNA, 24 bp, Artificial Sequence
  Synthetic Construct
tgaggactagaaagaggcactgat

SEQ ID NO: 26889 - DNA, 27 bp, Artificial Sequence
  Synthetic Construct
catgaagtgctactacgactcttaact

SEQ ID NO: 26890 - DNA, 22 bp, Artificial Sequence
  Synthetic Construct
gtggacaacccgtctcagattc

SEQ ID NO: 26891 - DNA, 19 bp, Artificial Sequence
  Synthetic Construct
cgccggactgtccactgat

SEQ ID NO: 26892 - DNA, 21 bp, Artificial Sequence
  Synthetic Construct
cctcctgctgcacatctttct

SEQ ID NO: 26893 - DNA, 22 bp, Artificial Sequence
  Synthetic Construct
tcagctccctgaggcatgtttg

SEQ ID NO: 26894 - DNA, 21 bp, Artificial Sequence
  Synthetic Construct
ttgaggatgcgtgggatgtag

SEQ ID NO: 26895 - DNA, 21 bp, Artificial Sequence
  Synthetic Construct
tgggcctcgtcaggcctttat

SEQ ID NO: 26896 - DNA, 21 bp, Artificial Sequence
  Synthetic Construct
cagcagcaaccatgctgcaaa

SEQ ID NO: 26897 - DNA, 20 bp, Artificial Sequence
  Synthetic Construct
acagcggagaaggtggtgaa

SEQ ID NO: 26898 - DNA, 22 bp, Artificial Sequence
  Synthetic Construct
gtcccatggatgagtggctttg

SEQ ID NO: 26899 - DNA, 22 bp, Artificial Sequence
  Synthetic Construct
aggctaggcaggcttaggattg

SEQ ID NO: 26900 - DNA, 20 bp, Artificial Sequence
  Synthetic Construct
ctcgcagagcagaacctcat

SEQ ID NO: 26901 - DNA, 22 bp, Artificial Sequence
  Synthetic Construct
agctcagggaggcggaagtatt

SEQ ID NO: 26902 - DNA, 20 bp, Artificial Sequence
  Synthetic Construct
cccactaggccaccctccat

SEQ ID NO: 26903 - DNA, 28 bp, Artificial Sequence
  Synthetic Construct
gacacagatctctggtaattcagagcaa

SEQ ID NO: 26904 - DNA, 21 bp, Artificial Sequence
  Synthetic Construct
ccaacagcaggtaggcaaatg

SEQ ID NO: 26905 - DNA, 23 bp, Artificial Sequence
  Synthetic Construct
gtaccactcagaccaggaaaaca

SEQ ID NO: 26906 - DNA, 20 bp, Artificial Sequence
  Synthetic Construct
ctccccaccttcgtctctga

SEQ ID NO: 26907 - DNA, 24 bp, Artificial Sequence
  Synthetic Construct
agatagcaatgctgcaacgtaaga

SEQ ID NO: 26908 - DNA, 23 bp, Artificial Sequence
  Synthetic Construct
gtgcaagttgctgttgtctcact

SEQ ID NO: 26909 - DNA, 23 bp, Artificial Sequence
  Synthetic Construct
tcaggaaccgtgactctttttca

SEQ ID NO: 26910 - DNA, 22 bp, Artificial Sequence
  Synthetic Construct
gctgccatcttgccactttgta

SEQ ID NO: 26911 - DNA, 22 bp, Artificial Sequence
  Synthetic Construct
cagtgcccacagccttcattgt

SEQ ID NO: 26912 - DNA, 21 bp, Artificial Sequence
  Synthetic Construct
ccaccgcagcagctattatgt

SEQ ID NO: 26913 - DNA, 21 bp, Artificial Sequence
  Synthetic Construct
tgtctgtcccggcaaccatag

SEQ ID NO: 26914 - DNA, 26 bp, Artificial Sequence
  Synthetic Construct
gctctccattatgccgtttatagtga

SEQ ID NO: 26915 - DNA, 22 bp, Artificial Sequence
  Synthetic Construct
cccctttccatactgtgctctt

SEQ ID NO: 26916 - DNA, 20 bp, Artificial Sequence
  Synthetic Construct
ggagcccagaccccaacaag

SEQ ID NO: 26917 - DNA, 19 bp, Artificial Sequence
  Synthetic Construct
caccacacccagcctctgt

SEQ ID NO: 26918 - DNA, 21 bp, Artificial Sequence
  Synthetic Construct
ccctaggggctgcaaggttac

SEQ ID NO: 26919 - DNA, 19 bp, Artificial Sequence
  Synthetic Construct
tcctgcttcagccgccaat

SEQ ID NO: 26920 - DNA, 19 bp, Artificial Sequence
  Synthetic Construct
tgtccccagcatcggatca

SEQ ID NO: 26921 - DNA, 22 bp, Artificial Sequence
  Synthetic Construct
gcactgtcctgtcctggttgaa

SEQ ID NO: 26922 - DNA, 20 bp, Artificial Sequence
  Synthetic Construct
ggtccagggatctggacaca

SEQ ID NO: 26923 - DNA, 20 bp, Artificial Sequence
  Synthetic Construct
gctgcacaccactgaccaat

SEQ ID NO: 26924 - DNA, 24 bp, Artificial Sequence
  Synthetic Construct
gagggaaggagccgcatgtataag

SEQ ID NO: 26925 - DNA, 22 bp, Artificial Sequence
  Synthetic Construct
gccctgtaacagtagccaaagt

SEQ ID NO: 26926 - DNA, 24 bp, Artificial Sequence
  Synthetic Construct
agagagagccttctttcccttaga

SEQ ID NO: 26927 - DNA, 23 bp, Artificial Sequence
  Synthetic Construct
caaagcatgccactactgtgtgt

SEQ ID NO: 26928 - DNA, 23 bp, Artificial Sequence
  Synthetic Construct
gtccctgtgaactcctgatcact

SEQ ID NO: 26929 - DNA, 20 bp, Artificial Sequence
  Synthetic Construct
acagggccttggtcttgctt

SEQ ID NO: 26930 - DNA, 21 bp, Artificial Sequence
  Synthetic Construct
tgcagtctgaacagcatggat

SEQ ID NO: 26931 - DNA, 22 bp, Artificial Sequence
  Synthetic Construct
ccaggcccactcaaagcacaaa

SEQ ID NO: 26932 - DNA, 21 bp, Artificial Sequence
  Synthetic Construct
ttccatgcctgcatagtgctt

SEQ ID NO: 26933 - DNA, 23 bp, Artificial Sequence
  Synthetic Construct
ctgagctgcctcctaaccacaag

SEQ ID NO: 26934 - DNA, 21 bp, Artificial Sequence
  Synthetic Construct
tcccaccaggtcctctgagat

SEQ ID NO: 26935 - DNA, 24 bp, Artificial Sequence
  Synthetic Construct
cacctctgctctttggtagtggat

SEQ ID NO: 26936 - DNA, 22 bp, Artificial Sequence
  Synthetic Construct
gtccatctccttgggagtgatg

SEQ ID NO: 26937 - DNA, 20 bp, Artificial Sequence
  Synthetic Construct
gcccaggggttctgggactt

SEQ ID NO: 26938 - DNA, 21 bp, Artificial Sequence
  Synthetic Construct
gttcctcctgcccatgcatta

SEQ ID NO: 26939 - DNA, 21 bp, Artificial Sequence
  Synthetic Construct
tcaatgcgctccctggtattt

SEQ ID NO: 26940 - DNA, 28 bp, Artificial Sequence
  Synthetic Construct
ggcagactttatttcccatttgctctac

SEQ ID NO: 26941 - DNA, 22 bp, Artificial Sequence
  Synthetic Construct
agatgctggcaaggaaggaaat

SEQ ID NO: 26942 - DNA, 20 bp, Artificial Sequence
  Synthetic Construct
agcggctcaggcacaaagaa

SEQ ID NO: 26943 - DNA, 20 bp, Artificial Sequence
  Synthetic Construct
agcaagagcacagggtggaa

SEQ ID NO: 26944 - DNA, 26 bp, Artificial Sequence
  Synthetic Construct
ttgccaccaatatcaggagtgtatag

SEQ ID NO: 26945 - DNA, 19 bp, Artificial Sequence
  Synthetic Construct
aggctcgggagaccggaaa

SEQ ID NO: 26946 - DNA, 20 bp, Artificial Sequence
  Synthetic Construct
agagcgtcagctccgaggtt

SEQ ID NO: 26947 - DNA, 20 bp, Artificial Sequence
  Synthetic Construct
aaggccacttagggcagaga

SEQ ID NO: 26948 - DNA, 19 bp, Artificial Sequence
  Synthetic Construct
tggctgcacaaccccagtt

SEQ ID NO: 26949 - DNA, 25 bp, Artificial Sequence
  Synthetic Construct
agcttcctggaaatctacattgtgt

SEQ ID NO: 26950 - DNA, 21 bp, Artificial Sequence
  Synthetic Construct
caatgccagttgcctctcaca

SEQ ID NO: 26951 - DNA, 22 bp, Artificial Sequence
  Synthetic Construct
agcatctggtggtgttttcgat

SEQ ID NO: 26952 - DNA, 21 bp, Artificial Sequence
  Synthetic Construct
gcagccggaggcattcactta

SEQ ID NO: 26953 - DNA, 20 bp, Artificial Sequence
  Synthetic Construct
tctgggccacctgatggtat

SEQ ID NO: 26954 - DNA, 20 bp, Artificial Sequence
  Synthetic Construct
ggcctttggccacagactga

SEQ ID NO: 26955 - DNA, 21 bp, Artificial Sequence
  Synthetic Construct
gcccagagaaatggagcacat

SEQ ID NO: 26956 - DNA, 24 bp, Artificial Sequence
  Synthetic Construct
cccaaaccatttccctatgcctta

SEQ ID NO: 26957 - DNA, 24 bp, Artificial Sequence
  Synthetic Construct
gcctgtctctgtcgtcactaggat

SEQ ID NO: 26958 - DNA, 22 bp, Artificial Sequence
  Synthetic Construct
ggtgtaaggagcaatgggatgt

SEQ ID NO: 26959 - DNA, 20 bp, Artificial Sequence
  Synthetic Construct
gggtgaaaacgcacccaaca

SEQ ID NO: 26960 - DNA, 21 bp, Artificial Sequence
  Synthetic Construct
ggtgtggtcaatggtgtcaga

SEQ ID NO: 26961 - DNA, 20 bp, Artificial Sequence
  Synthetic Construct
tgccgggcaatccagagaga

SEQ ID NO: 26962 - DNA, 19 bp, Artificial Sequence
  Synthetic Construct
gtgtgcctcgcctctttct

SEQ ID NO: 26963 - DNA, 25 bp, Artificial Sequence
  Synthetic Construct
ccagctttgctcttcataacagctt

SEQ ID NO: 26964 - DNA, 24 bp, Artificial Sequence
  Synthetic Construct
gagtgatagcactgagccagtaaa

SEQ ID NO: 26965 - DNA, 20 bp, Artificial Sequence
  Synthetic Construct
gctccgggtgcaggaatcaa

SEQ ID NO: 26966 - DNA, 23 bp, Artificial Sequence
  Synthetic Construct
aaatgcaacctatgccaggtact

SEQ ID NO: 26967 - DNA, 26 bp, Artificial Sequence
  Synthetic Construct
agtcacctccagctatgtttgaatac

SEQ ID NO: 26968 - DNA, 18 bp, Artificial Sequence
  Synthetic Construct
tgaggctgcgtgctctga

SEQ ID NO: 26969 - DNA, 24 bp, Artificial Sequence
  Synthetic Construct
ccttgtgctagacatgaagcaaga

SEQ ID NO: 26970 - DNA, 24 bp, Artificial Sequence
  Synthetic Construct
cccatagtcccatcctccctgaat

SEQ ID NO: 26971 - DNA, 18 bp, Artificial Sequence
  Synthetic Construct
aggcaggctctcgcatct

SEQ ID NO: 26972 - DNA, 22 bp, Artificial Sequence
  Synthetic Construct
ccgaccctgctgcaacaaatga

SEQ ID NO: 26973 - DNA, 25 bp, Artificial Sequence
  Synthetic Construct
tgactgcttttccaaaactggtact

SEQ ID NO: 26974 - DNA, 20 bp, Artificial Sequence
  Synthetic Construct
aagggccacctgtcagaagt

SEQ ID NO: 26975 - DNA, 24 bp, Artificial Sequence
  Synthetic Construct
gtggctggttcctatggtatgaga

SEQ ID NO: 26976 - DNA, 24 bp, Artificial Sequence
  Synthetic Construct
ggctcatcgcatgcatctttgatt

SEQ ID NO: 26977 - DNA, 22 bp, Artificial Sequence
  Synthetic Construct
caatctcaagccctgggcaaag

SEQ ID NO: 26978 - DNA, 21 bp, Artificial Sequence
  Synthetic Construct
accctgtagcaggagctgtgt

SEQ ID NO: 26979 - DNA, 24 bp, Artificial Sequence
  Synthetic Construct
tggcttatatggcctcacctatct

SEQ ID NO: 26980 - DNA, 21 bp, Artificial Sequence
  Synthetic Construct
aggactggggtggtgaaggaa

SEQ ID NO: 26981 - DNA, 21 bp, Artificial Sequence
  Synthetic Construct
gggtgcagggaatgcacagat

SEQ ID NO: 26982 - DNA, 24 bp, Artificial Sequence
  Synthetic Construct
cctcaaatgagggcagggacattc

SEQ ID NO: 26983 - DNA, 24 bp, Artificial Sequence
  Synthetic Construct
tgtcgtatcccagggttgtatttc

SEQ ID NO: 26984 - DNA, 20 bp, Artificial Sequence
  Synthetic Construct
ggggccagagagctttcact

SEQ ID NO: 26985 - DNA, 24 bp, Artificial Sequence
  Synthetic Construct
ccatctcgacgcagagagaacctt

SEQ ID NO: 26986 - DNA, 21 bp, Artificial Sequence
  Synthetic Construct
ggaaacagacgggcgtccata

SEQ ID NO: 26987 - DNA, 22 bp, Artificial Sequence
  Synthetic Construct
aggatcacctgagcctgggatt

SEQ ID NO: 26988 - DNA, 23 bp, Artificial Sequence
  Synthetic Construct
cactgggctgctcatagaataca

SEQ ID NO: 26989 - DNA, 20 bp, Artificial Sequence
  Synthetic Construct
tggcccagcccagaaaaact

SEQ ID NO: 26990 - DNA, 22 bp, Artificial Sequence
  Synthetic Construct
gtgagcctccagatgtttcctt

SEQ ID NO: 26991 - DNA, 19 bp, Artificial Sequence
  Synthetic Construct
gagaccgctgccacagtca

SEQ ID NO: 26992 - DNA, 22 bp, Artificial Sequence
  Synthetic Construct
accaaaccccttaggcccacta

SEQ ID NO: 26993 - DNA, 25 bp, Artificial Sequence
  Synthetic Construct
cattgatcagggtactgaagtggta

SEQ ID NO: 26994 - DNA, 20 bp, Artificial Sequence
  Synthetic Construct
ggagacagagctcccgattg

SEQ ID NO: 26995 - DNA, 23 bp, Artificial Sequence
  Synthetic Construct
caagcagataggaggcgatcaga

SEQ ID NO: 26996 - DNA, 23 bp, Artificial Sequence
  Synthetic Construct
gctcatcacactcaccccagcta

SEQ ID NO: 26997 - DNA, 18 bp, Artificial Sequence
  Synthetic Construct
tgagggtggcagcgtcat

SEQ ID NO: 26998 - DNA, 20 bp, Artificial Sequence
  Synthetic Construct
gcacagcactctgcccttca

SEQ ID NO: 26999 - DNA, 24 bp, Artificial Sequence
  Synthetic Construct
ggtctgggccttaagaggcattga

SEQ ID NO: 27000 - DNA, 21 bp, Artificial Sequence
  Synthetic Construct
tgccctggggcgaggttatta

SEQ ID NO: 27001 - DNA, 20 bp, Artificial Sequence
  Synthetic Construct
caccaggacaagtgctgtct

SEQ ID NO: 27002 - DNA, 22 bp, Artificial Sequence
  Synthetic Construct
ggagcatcgctcagctcttctt

SEQ ID NO: 27003 - DNA, 20 bp, Artificial Sequence
  Synthetic Construct
ccgccttgacagcaggaagt

SEQ ID NO: 27004 - DNA, 24 bp, Artificial Sequence
  Synthetic Construct
atgcaacttccctgaaaggagtaa

SEQ ID NO: 27005 - DNA, 23 bp, Artificial Sequence
  Synthetic Construct
ctgccttgctggatggcaaaatg

SEQ ID NO: 27006 - DNA, 21 bp, Artificial Sequence
  Synthetic Construct
catttgggagccatggtggta

SEQ ID NO: 27007 - DNA, 23 bp, Artificial Sequence
  Synthetic Construct
gggctaggagcccaatatcattt

SEQ ID NO: 27008 - DNA, 23 bp, Artificial Sequence
  Synthetic Construct
cccatctcccttcccatctgtct

SEQ ID NO: 27009 - DNA, 22 bp, Artificial Sequence
  Synthetic Construct
caggaagctccacacaaacaca

SEQ ID NO: 27010 - DNA, 19 bp, Artificial Sequence
  Synthetic Construct
cagtgccctccagccaaag

SEQ ID NO: 27011 - DNA, 20 bp, Artificial Sequence
  Synthetic Construct
gtcaccgacaccctgtggat

SEQ ID NO: 27012 - DNA, 23 bp, Artificial Sequence
  Synthetic Construct
acaagaggccctagaatccaagt

SEQ ID NO: 27013 - DNA, 19 bp, Artificial Sequence
  Synthetic Construct
ggcggactccacctgaaga

SEQ ID NO: 27014 - DNA, 23 bp, Artificial Sequence
  Synthetic Construct
ccattctcgtggtccatttgtct

SEQ ID NO: 27015 - DNA, 22 bp, Artificial Sequence
  Synthetic Construct
gatcaggttgcagtctcagcat

SEQ ID NO: 27016 - DNA, 23 bp, Artificial Sequence
  Synthetic Construct
ggcagtagagaagggtctaggat

SEQ ID NO: 27017 - DNA, 23 bp, Artificial Sequence
  Synthetic Construct
tcaccagatggcatttgtcttca

SEQ ID NO: 27018 - DNA, 25 bp, Artificial Sequence
  Synthetic Construct
actgaactacctggacatctgtttt

SEQ ID NO: 27019 - DNA, 20 bp, Artificial Sequence
  Synthetic Construct
gcaggcacacggaatgcaaa

SEQ ID NO: 27020 - DNA, 20 bp, Artificial Sequence
  Synthetic Construct
acagccctcccggctgactt

SEQ ID NO: 27021 - DNA, 21 bp, Artificial Sequence
  Synthetic Construct
cagtggtgacctgtgggaaag

SEQ ID NO: 27022 - DNA, 22 bp, Artificial Sequence
  Synthetic Construct
cccgacccctgatacttcacaa

SEQ ID NO: 27023 - DNA, 22 bp, Artificial Sequence
  Synthetic Construct
gaggcagttctggccataggat

SEQ ID NO: 27024 - DNA, 23 bp, Artificial Sequence
  Synthetic Construct
tgccatcttcttcattgcagttg

SEQ ID NO: 27025 - DNA, 21 bp, Artificial Sequence
  Synthetic Construct
gcacaggcaacatcacagttg

SEQ ID NO: 27026 - DNA, 22 bp, Artificial Sequence
  Synthetic Construct
ggagacccaactgtgaacaaga

SEQ ID NO: 27027 - DNA, 24 bp, Artificial Sequence
  Synthetic Construct
tcatgcctgggaccaaattctaag

SEQ ID NO: 27028 - DNA, 21 bp, Artificial Sequence
  Synthetic Construct
gcagctgcctctgagtgtttg

SEQ ID NO: 27029 - DNA, 20 bp, Artificial Sequence
  Synthetic Construct
tccctggctccgtggtgctt

SEQ ID NO: 27030 - DNA, 21 bp, Artificial Sequence
  Synthetic Construct
tgccgttgtttggaagcacta

SEQ ID NO: 27031 - DNA, 25 bp, Artificial Sequence
  Synthetic Construct
aggttacaaccttgaaaacccaaac

SEQ ID NO: 27032 - DNA, 21 bp, Artificial Sequence
  Synthetic Construct
gggagggatggggtcgaaatc

SEQ ID NO: 27033 - DNA, 20 bp, Artificial Sequence
  Synthetic Construct
aagggtcggcggggttcaga

SEQ ID NO: 27034 - DNA, 23 bp, Artificial Sequence
  Synthetic Construct
gctgattaggtgactctgtccaa

SEQ ID NO: 27035 - DNA, 18 bp, Artificial Sequence
  Synthetic Construct
tggcagcactgggcacat

SEQ ID NO: 27036 - DNA, 20 bp, Artificial Sequence
  Synthetic Construct
tcctggagcacagccttcat

SEQ ID NO: 27037 - DNA, 22 bp, Artificial Sequence
  Synthetic Construct
gggacctgagcctctgttttga

SEQ ID NO: 27038 - DNA, 20 bp, Artificial Sequence
  Synthetic Construct
ccaccacaaccactccagtt

SEQ ID NO: 27039 - DNA, 20 bp, Artificial Sequence
  Synthetic Construct
tgccctgaggtttgcgtagt

SEQ ID NO: 27040 - DNA, 22 bp, Artificial Sequence
  Synthetic Construct
gattctgcagcaaggtgctatg

SEQ ID NO: 27041 - DNA, 18 bp, Artificial Sequence
  Synthetic Construct
tggaaggggcgagggaat

SEQ ID NO: 27042 - DNA, 21 bp, Artificial Sequence
  Synthetic Construct
actgggctgattcgtctcact

SEQ ID NO: 27043 - DNA, 20 bp, Artificial Sequence
  Synthetic Construct
ggcaggcctaacagttccat

SEQ ID NO: 27044 - DNA, 20 bp, Artificial Sequence
  Synthetic Construct
acgagcttttggctgtgcaa

SEQ ID NO: 27045 - DNA, 25 bp, Artificial Sequence
  Synthetic Construct
ccatcctggtgactgtttcctttca

SEQ ID NO: 27046 - DNA, 21 bp, Artificial Sequence
  Synthetic Construct
gagccgaacaagcgtttctgt

SEQ ID NO: 27047 - DNA, 22 bp, Artificial Sequence
  Synthetic Construct
tgtggcagtggggaaggtgtaa

SEQ ID NO: 27048 - DNA, 23 bp, Artificial Sequence
  Synthetic Construct
gtgctgttttcctcccaccttct

SEQ ID NO: 27049 - DNA, 20 bp, Artificial Sequence
  Synthetic Construct
aagccctgcccacccactga

SEQ ID NO: 27050 - DNA, 23 bp, Artificial Sequence
  Synthetic Construct
gctgccttgggaatagacgttca

SEQ ID NO: 27051 - DNA, 23 bp, Artificial Sequence
  Synthetic Construct
agatgctctgtcctggatgatgt

SEQ ID NO: 27052 - DNA, 22 bp, Artificial Sequence
  Synthetic Construct
ctccctgacaacgtctggaatg

SEQ ID NO: 27053 - DNA, 25 bp, Artificial Sequence
  Synthetic Construct
gctctcatcacactttggaccttga

SEQ ID NO: 27054 - DNA, 23 bp, Artificial Sequence
  Synthetic Construct
tgtagggtggggttgagagattt

SEQ ID NO: 27055 - DNA, 20 bp, Artificial Sequence
  Synthetic Construct
gcggttggtgctcctcctaa

SEQ ID NO: 27056 - DNA, 21 bp, Artificial Sequence
  Synthetic Construct
gcactgtgctcctgctgtttg

SEQ ID NO: 27057 - DNA, 19 bp, Artificial Sequence
  Synthetic Construct
tgccaagccaccacagaaa

SEQ ID NO: 27058 - DNA, 21 bp, Artificial Sequence
  Synthetic Construct
tccccatgcacacaccctcta

SEQ ID NO: 27059 - DNA, 21 bp, Artificial Sequence
  Synthetic Construct
aggaaggcagatggtgtcaac

SEQ ID NO: 27060 - DNA, 21 bp, Artificial Sequence
  Synthetic Construct
gggccttgcctcccagaaaat

SEQ ID NO: 27061 - DNA, 25 bp, Artificial Sequence
  Synthetic Construct
tttccatttctccctcgcttattct

SEQ ID NO: 27062 - DNA, 20 bp, Artificial Sequence
  Synthetic Construct
aactgttcctgcagcccttt

SEQ ID NO: 27063 - DNA, 20 bp, Artificial Sequence
  Synthetic Construct
tcccagcacaatgcctgtct

SEQ ID NO: 27064 - DNA, 24 bp, Artificial Sequence
  Synthetic Construct
gccttcagtatgtcttgcgtcttg

SEQ ID NO: 27065 - DNA, 22 bp, Artificial Sequence
  Synthetic Construct
ggagggcagtggcacaatcata

SEQ ID NO: 27066 - DNA, 21 bp, Artificial Sequence
  Synthetic Construct
aagggtggcaccgaagtcaga

SEQ ID NO: 27067 - DNA, 23 bp, Artificial Sequence
  Synthetic Construct
ggccaaggtggaaggattgctta

SEQ ID NO: 27068 - DNA, 20 bp, Artificial Sequence
  Synthetic Construct
aggtgaagctgagccacttg

SEQ ID NO: 27069 - DNA, 22 bp, Artificial Sequence
  Synthetic Construct
ctaccaagtctgctgtcccaaa

SEQ ID NO: 27070 - DNA, 24 bp, Artificial Sequence
  Synthetic Construct
cccacgctgattaatgctcctttg

SEQ ID NO: 27071 - DNA, 22 bp, Artificial Sequence
  Synthetic Construct
gagaggctttgaggcattgaga

SEQ ID NO: 27072 - DNA, 22 bp, Artificial Sequence
  Synthetic Construct
ggcagttggggaggaaaggtat

SEQ ID NO: 27073 - DNA, 21 bp, Artificial Sequence
  Synthetic Construct
gcaaggctggaccaggaatgt

SEQ ID NO: 27074 - DNA, 21 bp, Artificial Sequence
  Synthetic Construct
agacaaagtcctccccactct

SEQ ID NO: 27075 - DNA, 19 bp, Artificial Sequence
  Synthetic Construct
acacaggcagcgtttgctt

SEQ ID NO: 27076 - DNA, 22 bp, Artificial Sequence
  Synthetic Construct
attaagccccatgggtggtatg

SEQ ID NO: 27077 - DNA, 20 bp, Artificial Sequence
  Synthetic Construct
caaagtcggcccgtctcact

SEQ ID NO: 27078 - DNA, 23 bp, Artificial Sequence
  Synthetic Construct
cctcatccagagattgcaaggtt

SEQ ID NO: 27079 - DNA, 22 bp, Artificial Sequence
  Synthetic Construct
ctacctgcctgcactgtagatg

SEQ ID NO: 27080 - DNA, 21 bp, Artificial Sequence
  Synthetic Construct
agcctgctgatgcaggagttg

SEQ ID NO: 27081 - DNA, 25 bp, Artificial Sequence
  Synthetic Construct
gcgagactgattacagactgagcta

SEQ ID NO: 27082 - DNA, 22 bp, Artificial Sequence
  Synthetic Construct
gcgctgaagtgttgcattctgt

SEQ ID NO: 27083 - DNA, 20 bp, Artificial Sequence
  Synthetic Construct
tggccgaggctgtgaaggta

SEQ ID NO: 27084 - DNA, 21 bp, Artificial Sequence
  Synthetic Construct
ccagctccccttgtggttaaa

SEQ ID NO: 27085 - DNA, 20 bp, Artificial Sequence
  Synthetic Construct
ggcatgcctttccacctagt

SEQ ID NO: 27086 - DNA, 21 bp, Artificial Sequence
  Synthetic Construct
agcctccactcccctccttct

SEQ ID NO: 27087 - DNA, 21 bp, Artificial Sequence
  Synthetic Construct
gctccccgaggctgtgagtaa

SEQ ID NO: 27088 - DNA, 21 bp, Artificial Sequence
  Synthetic Construct
gggtccacagtgtccgtgttt

SEQ ID NO: 27089 - DNA, 19 bp, Artificial Sequence
  Synthetic Construct
agccccagctctcccatgt

SEQ ID NO: 27090 - DNA, 21 bp, Artificial Sequence
  Synthetic Construct
tcgactgctctgtgcccatct

SEQ ID NO: 27091 - DNA, 21 bp, Artificial Sequence
  Synthetic Construct
ggtgaaggcaaagtcctcctt

SEQ ID NO: 27092 - DNA, 18 bp, Artificial Sequence
  Synthetic Construct
acagccctgctgctgctt

SEQ ID NO: 27093 - DNA, 22 bp, Artificial Sequence
  Synthetic Construct
cacacacagtcctaggccatac

SEQ ID NO: 27094 - DNA, 20 bp, Artificial Sequence
  Synthetic Construct
tctgggtcgcgtaactccat

SEQ ID NO: 27095 - DNA, 19 bp, Artificial Sequence
  Synthetic Construct
gctggcggagcagttcgta

SEQ ID NO: 27096 - DNA, 18 bp, Artificial Sequence
  Synthetic Construct
aggcagcctggccttaca

SEQ ID NO: 27097 - DNA, 19 bp, Artificial Sequence
  Synthetic Construct
aggcttggcaaggccatca

SEQ ID NO: 27098 - DNA, 19 bp, Artificial Sequence
  Synthetic Construct
agtcgtgggctgtgtgcat

SEQ ID NO: 27099 - DNA, 22 bp, Artificial Sequence
  Synthetic Construct
tgcctgttatgcacaagcacta

SEQ ID NO: 27100 - DNA, 20 bp, Artificial Sequence
  Synthetic Construct
ggggcagctggagactggat

SEQ ID NO: 27101 - DNA, 25 bp, Artificial Sequence
  Synthetic Construct
agggaatggggaatattgaatgctt

SEQ ID NO: 27102 - DNA, 19 bp, Artificial Sequence
  Synthetic Construct
gggtggggctcagtgttga

SEQ ID NO: 27103 - DNA, 19 bp, Artificial Sequence
  Synthetic Construct
gcagagcagggtgaacagt

SEQ ID NO: 27104 - DNA, 20 bp, Artificial Sequence
  Synthetic Construct
tgcccaggcttcttggtgtt

SEQ ID NO: 27105 - DNA, 21 bp, Artificial Sequence
  Synthetic Construct
aggaggatggggacgaaggat

SEQ ID NO: 27106 - DNA, 21 bp, Artificial Sequence
  Synthetic Construct
gttgctgacaggtcagtgtct

SEQ ID NO: 27107 - DNA, 19 bp, Artificial Sequence
  Synthetic Construct
ccctaggccactgcagcaa

SEQ ID NO: 27108 - DNA, 20 bp, Artificial Sequence
  Synthetic Construct
gacaagcctggggaaactgt

SEQ ID NO: 27109 - DNA, 20 bp, Artificial Sequence
  Synthetic Construct
acgcagcacccagaggtaat

SEQ ID NO: 27110 - DNA, 21 bp, Artificial Sequence
  Synthetic Construct
tgtgggccacctctttttgaa

SEQ ID NO: 27111 - DNA, 23 bp, Artificial Sequence
  Synthetic Construct
gccttttgtgcagtggtcagcat

SEQ ID NO: 27112 - DNA, 20 bp, Artificial Sequence
  Synthetic Construct
ttaggccccactgcagatca

SEQ ID NO: 27113 - DNA, 22 bp, Artificial Sequence
  Synthetic Construct
ggggaaccacccaaggttcttt

SEQ ID NO: 27114 - DNA, 20 bp, Artificial Sequence
  Synthetic Construct
agtggcacttccacctgtga

SEQ ID NO: 27115 - DNA, 22 bp, Artificial Sequence
  Synthetic Construct
agacctcagaacggagttgttc

SEQ ID NO: 27116 - DNA, 20 bp, Artificial Sequence
  Synthetic Construct
agacggccagaagtgactgt

SEQ ID NO: 27117 - DNA, 18 bp, Artificial Sequence
  Synthetic Construct
cacgagcaccaggcatca

SEQ ID NO: 27118 - DNA, 23 bp, Artificial Sequence
  Synthetic Construct
gggcaaagctcttgagaccagaa

SEQ ID NO: 27119 - DNA, 21 bp, Artificial Sequence
  Synthetic Construct
agtgaacgctgtgggtttgtt

SEQ ID NO: 27120 - DNA, 22 bp, Artificial Sequence
  Synthetic Construct
cgagagcctggggtagtttttg

SEQ ID NO: 27121 - DNA, 20 bp, Artificial Sequence
  Synthetic Construct
agtgttccgcttggctggta

SEQ ID NO: 27122 - DNA, 26 bp, Artificial Sequence
  Synthetic Construct
gagagaacggacaacttttcccaaca

SEQ ID NO: 27123 - DNA, 20 bp, Artificial Sequence
  Synthetic Construct
gcagcctccacagagaacat

SEQ ID NO: 27124 - DNA, 22 bp, Artificial Sequence
  Synthetic Construct
cctgcagccaagtgcttactct

SEQ ID NO: 27125 - DNA, 24 bp, Artificial Sequence
  Synthetic Construct
ttgagcagctaccatattcacaca

SEQ ID NO: 27126 - DNA, 23 bp, Artificial Sequence
  Synthetic Construct
cacatgcacacacactggataga

SEQ ID NO: 27127 - DNA, 22 bp, Artificial Sequence
  Synthetic Construct
attttgccccagaagctacagt

SEQ ID NO: 27128 - DNA, 22 bp, Artificial Sequence
  Synthetic Construct
gctcagacccttgtgcttctct

SEQ ID NO: 27129 - DNA, 21 bp, Artificial Sequence
  Synthetic Construct
gagactgcattggcgtactga

SEQ ID NO: 27130 - DNA, 21 bp, Artificial Sequence
  Synthetic Construct
gccacctttcctctgcaagtt

SEQ ID NO: 27131 - DNA, 20 bp, Artificial Sequence
  Synthetic Construct
tggcagcaagaggactgaca

SEQ ID NO: 27132 - DNA, 24 bp, Artificial Sequence
  Synthetic Construct
ggataggacagtagccatggagtt

SEQ ID NO: 27133 - DNA, 27 bp, Artificial Sequence
  Synthetic Construct
gctttttgtaggagtaagaagggagaa

SEQ ID NO: 27134 - DNA, 21 bp, Artificial Sequence
  Synthetic Construct
ggacacccgagacctgtgcta

SEQ ID NO: 27135 - DNA, 19 bp, Artificial Sequence
  Synthetic Construct
ccaccagctgcttggcata

SEQ ID NO: 27136 - DNA, 20 bp, Artificial Sequence
  Synthetic Construct
cctgagcctggcctgagatg

SEQ ID NO: 27137 - DNA, 22 bp, Artificial Sequence
  Synthetic Construct
ggtccacgtccgtgcctttatt

SEQ ID NO: 27138 - DNA, 22 bp, Artificial Sequence
  Synthetic Construct
gggaaaagcacgtttgttcagt

SEQ ID NO: 27139 - DNA, 22 bp, Artificial Sequence
  Synthetic Construct
gcttctctttcctctccgaaca

SEQ ID NO: 27140 - DNA, 22 bp, Artificial Sequence
  Synthetic Construct
aggctcagggaggttaggatac

SEQ ID NO: 27141 - DNA, 22 bp, Artificial Sequence
  Synthetic Construct
ccatgtccctggcactctgttt

SEQ ID NO: 27142 - DNA, 23 bp, Artificial Sequence
  Synthetic Construct
actttgggattctggaggacaga

SEQ ID NO: 27143 - DNA, 24 bp, Artificial Sequence
  Synthetic Construct
aaaatgcctctgcttctaggatga

SEQ ID NO: 27144 - DNA, 22 bp, Artificial Sequence
  Synthetic Construct
aacgtgacaggaaggacacttt

SEQ ID NO: 27145 - DNA, 24 bp, Artificial Sequence
  Synthetic Construct
gctacttggataggccttgctttg

SEQ ID NO: 27146 - DNA, 18 bp, Artificial Sequence
  Synthetic Construct
accgtgcccagccttgtt

SEQ ID NO: 27147 - DNA, 18 bp, Artificial Sequence
  Synthetic Construct
tgtgcagctggcgtgaat

SEQ ID NO: 27148 - DNA, 20 bp, Artificial Sequence
  Synthetic Construct
aggccccacttcttgggatt

SEQ ID NO: 27149 - DNA, 22 bp, Artificial Sequence
  Synthetic Construct
aaacacactggaagcctgaaga

SEQ ID NO: 27150 - DNA, 20 bp, Artificial Sequence
  Synthetic Construct
acgcggcaggtgcctaggat

SEQ ID NO: 27151 - DNA, 22 bp, Artificial Sequence
  Synthetic Construct
ggagtccacctcaccgacttac

SEQ ID NO: 27152 - DNA, 19 bp, Artificial Sequence
  Synthetic Construct
tggacagcctctgctgcat

SEQ ID NO: 27153 - DNA, 23 bp, Artificial Sequence
  Synthetic Construct
tcaaattcctgcatagggcaaca

SEQ ID NO: 27154 - DNA, 22 bp, Artificial Sequence
  Synthetic Construct
ccctggtgggcacttcaacatt

SEQ ID NO: 27155 - DNA, 21 bp, Artificial Sequence
  Synthetic Construct
ttccccagcagagacggtgaa

SEQ ID NO: 27156 - DNA, 24 bp, Artificial Sequence
  Synthetic Construct
tttccagaaattcaggccactttg

SEQ ID NO: 27157 - DNA, 22 bp, Artificial Sequence
  Synthetic Construct
cctcgggttccagagtctgttg

SEQ ID NO: 27158 - DNA, 23 bp, Artificial Sequence
  Synthetic Construct
ctcacttgacagggacaagaagt

SEQ ID NO: 27159 - DNA, 21 bp, Artificial Sequence
  Synthetic Construct
aggcaccgcataccctgaagt

SEQ ID NO: 27160 - DNA, 21 bp, Artificial Sequence
  Synthetic Construct
tgctgagctgatgggttgtag

SEQ ID NO: 27161 - DNA, 23 bp, Artificial Sequence
  Synthetic Construct
gggaacatgctggaaggattcta

SEQ ID NO: 27162 - DNA, 20 bp, Artificial Sequence
  Synthetic Construct
atggtccccagttccctctt

SEQ ID NO: 27163 - DNA, 19 bp, Artificial Sequence
  Synthetic Construct
aggcgcagcccttcctcaa

SEQ ID NO: 27164 - DNA, 21 bp, Artificial Sequence
  Synthetic Construct
gctttgaagagcgaggtcaca

SEQ ID NO: 27165 - DNA, 21 bp, Artificial Sequence
  Synthetic Construct
ccaagaggcaggcattaccat

SEQ ID NO: 27166 - DNA, 20 bp, Artificial Sequence
  Synthetic Construct
gctttttggggcatgcagtt

SEQ ID NO: 27167 - DNA, 20 bp, Artificial Sequence
  Synthetic Construct
gcaatgccagagaggcaaga

SEQ ID NO: 27168 - DNA, 25 bp, Artificial Sequence
  Synthetic Construct
ggaaagttgtgccaaggcaaagaga

SEQ ID NO: 27169 - DNA, 21 bp, Artificial Sequence
  Synthetic Construct
acagtcccagcctgacagttc

SEQ ID NO: 27170 - DNA, 18 bp, Artificial Sequence
  Synthetic Construct
cgggcatgcttgctctgt

SEQ ID NO: 27171 - DNA, 22 bp, Artificial Sequence
  Synthetic Construct
ccctccctagccaatgcttaac

SEQ ID NO: 27172 - DNA, 21 bp, Artificial Sequence
  Synthetic Construct
gtggcccatgttggagaatga

SEQ ID NO: 27173 - DNA, 24 bp, Artificial Sequence
  Synthetic Construct
gcctccaggtactcatccacttgt

SEQ ID NO: 27174 - DNA, 26 bp, Artificial Sequence
  Synthetic Construct
ggaaagaaggctagtggtaagagaca

SEQ ID NO: 27175 - DNA, 21 bp, Artificial Sequence
  Synthetic Construct
cgttgagggcaggagggaaat

SEQ ID NO: 27176 - DNA, 22 bp, Artificial Sequence
  Synthetic Construct
caactgtgccaggggtcctaaa

SEQ ID NO: 27177 - DNA, 20 bp, Artificial Sequence
  Synthetic Construct
cagccccttgctgggaatca

SEQ ID NO: 27178 - DNA, 20 bp, Artificial Sequence
  Synthetic Construct
gcctccttgccagtcaccta

SEQ ID NO: 27179 - DNA, 21 bp, Artificial Sequence
  Synthetic Construct
ccacactgtgttggccaatgt

SEQ ID NO: 27180 - DNA, 19 bp, Artificial Sequence
  Synthetic Construct
cgccactggaaccagaact

SEQ ID NO: 27181 - DNA, 20 bp, Artificial Sequence
  Synthetic Construct
tggcttgggtgtgggttcaa

SEQ ID NO: 27182 - DNA, 20 bp, Artificial Sequence
  Synthetic Construct
caggtgctccaggctgtgat

SEQ ID NO: 27183 - DNA, 23 bp, Artificial Sequence
  Synthetic Construct
gtgcttttggaccactccctttg

SEQ ID NO: 27184 - DNA, 21 bp, Artificial Sequence
  Synthetic Construct
aaggtccagggagtggacaca

SEQ ID NO: 27185 - DNA, 21 bp, Artificial Sequence
  Synthetic Construct
gcgacgggaggagttgagttg

SEQ ID NO: 27186 - DNA, 23 bp, Artificial Sequence
  Synthetic Construct
gcaaagggaagtccagaggaaac

SEQ ID NO: 27187 - DNA, 23 bp, Artificial Sequence
  Synthetic Construct
ctaggacaatctcaccccacaag

SEQ ID NO: 27188 - DNA, 19 bp, Artificial Sequence
  Synthetic Construct
ccatgcagcaagggcctat

SEQ ID NO: 27189 - DNA, 20 bp, Artificial Sequence
  Synthetic Construct
cagcagcctctggtctcttc

SEQ ID NO: 27190 - DNA, 20 bp, Artificial Sequence
  Synthetic Construct
tggcagggttggggagagat

SEQ ID NO: 27191 - DNA, 19 bp, Artificial Sequence
  Synthetic Construct
agccactgcactgggctta

SEQ ID NO: 27192 - DNA, 22 bp, Artificial Sequence
  Synthetic Construct
cctggcccagagtaggtgttta

SEQ ID NO: 27193 - DNA, 21 bp, Artificial Sequence
  Synthetic Construct
tgggagaggcatgtggaatga

SEQ ID NO: 27194 - DNA, 22 bp, Artificial Sequence
  Synthetic Construct
ggatgcagggacatcagctaag

SEQ ID NO: 27195 - DNA, 24 bp, Artificial Sequence
  Synthetic Construct
tcccctaccccaaccctaattaaa

SEQ ID NO: 27196 - DNA, 20 bp, Artificial Sequence
  Synthetic Construct
aatgggcacagccacaggtt

SEQ ID NO: 27197 - DNA, 22 bp, Artificial Sequence
  Synthetic Construct
gcccagccaggctaaatgactt

SEQ ID NO: 27198 - DNA, 22 bp, Artificial Sequence
  Synthetic Construct
cctgaagcaggtttggaagact

SEQ ID NO: 27199 - DNA, 20 bp, Artificial Sequence
  Synthetic Construct
tggggccacctacctggata

SEQ ID NO: 27200 - DNA, 22 bp, Artificial Sequence
  Synthetic Construct
gagcctggcactcaaaaactga

SEQ ID NO: 27201 - DNA, 22 bp, Artificial Sequence
  Synthetic Construct
ggtgtggggagacctctatgtt

SEQ ID NO: 27202 - DNA, 20 bp, Artificial Sequence
  Synthetic Construct
ggggcattccaggccctatt

SEQ ID NO: 27203 - DNA, 22 bp, Artificial Sequence
  Synthetic Construct
ccacatgggctgaagggttcat

SEQ ID NO: 27204 - DNA, 20 bp, Artificial Sequence
  Synthetic Construct
accccaaggaggaaccaagt

SEQ ID NO: 27205 - DNA, 21 bp, Artificial Sequence
  Synthetic Construct
gtcgcggtatgagggaggatt

SEQ ID NO: 27206 - DNA, 23 bp, Artificial Sequence
  Synthetic Construct
tgagtgcttgatgtttcccttca

SEQ ID NO: 27207 - DNA, 19 bp, Artificial Sequence
  Synthetic Construct
tctggcagctggcttcttg

SEQ ID NO: 27208 - DNA, 20 bp, Artificial Sequence
  Synthetic Construct
ctgtcccaggccttttgtgt

SEQ ID NO: 27209 - DNA, 26 bp, Artificial Sequence
  Synthetic Construct
gagttgagtttcgagtgcaaaacttg

SEQ ID NO: 27210 - DNA, 24 bp, Artificial Sequence
  Synthetic Construct
gtggttttgtcccattccctcttt

SEQ ID NO: 27211 - DNA, 21 bp, Artificial Sequence
  Synthetic Construct
tggctgaccaggggcatcttt

SEQ ID NO: 27212 - DNA, 23 bp, Artificial Sequence
  Synthetic Construct
gccatgtccctgggatctgtcta

SEQ ID NO: 27213 - DNA, 19 bp, Artificial Sequence
  Synthetic Construct
tgggttcggggcccaacaa

SEQ ID NO: 27214 - DNA, 23 bp, Artificial Sequence
  Synthetic Construct
gcatttctgtggtgggatagtgt

SEQ ID NO: 27215 - DNA, 22 bp, Artificial Sequence
  Synthetic Construct
gtctgcctcactagtggcctat

SEQ ID NO: 27216 - DNA, 22 bp, Artificial Sequence
  Synthetic Construct
gggaaacaagcacagactccaa

SEQ ID NO: 27217 - DNA, 22 bp, Artificial Sequence
  Synthetic Construct
gggtcacttcctccttggattc

SEQ ID NO: 27218 - DNA, 24 bp, Artificial Sequence
  Synthetic Construct
gggagtcgctatttaccgagcttt

SEQ ID NO: 27219 - DNA, 19 bp, Artificial Sequence
  Synthetic Construct
accctgggcaagacactct

SEQ ID NO: 27220 - DNA, 20 bp, Artificial Sequence
  Synthetic Construct
gcgctcagccatttgcatca

SEQ ID NO: 27221 - DNA, 19 bp, Artificial Sequence
  Synthetic Construct
accgccccaggaagcttag

SEQ ID NO: 27222 - DNA, 22 bp, Artificial Sequence
  Synthetic Construct
gctgcagaggctcaaagctaga

SEQ ID NO: 27223 - DNA, 23 bp, Artificial Sequence
  Synthetic Construct
aggaaaccagatctgtgcacttg

SEQ ID NO: 27224 - DNA, 20 bp, Artificial Sequence
  Synthetic Construct
tgggtgaggctactgtgagt

SEQ ID NO: 27225 - DNA, 22 bp, Artificial Sequence
  Synthetic Construct
gtcaaaggggaagcatgcaaag

SEQ ID NO: 27226 - DNA, 24 bp, Artificial Sequence
  Synthetic Construct
tccaagaagaggtgtgcaaaatga

SEQ ID NO: 27227 - DNA, 25 bp, Artificial Sequence
  Synthetic Construct
cagtacctggcccataaaaggtagt

SEQ ID NO: 27228 - DNA, 21 bp, Artificial Sequence
  Synthetic Construct
ttcagctgtttccaccacagt

SEQ ID NO: 27229 - DNA, 22 bp, Artificial Sequence
  Synthetic Construct
aggagagaggcggaaggaacaa

SEQ ID NO: 27230 - DNA, 19 bp, Artificial Sequence
  Synthetic Construct
cagcccagcaagcctccaa

SEQ ID NO: 27231 - DNA, 22 bp, Artificial Sequence
  Synthetic Construct
tggaggtcaggtactgaagaca

SEQ ID NO: 27232 - DNA, 22 bp, Artificial Sequence
  Synthetic Construct
actggactcctctccccacatt

SEQ ID NO: 27233 - DNA, 20 bp, Artificial Sequence
  Synthetic Construct
gcccaagaggcaggcatcaa

SEQ ID NO: 27234 - DNA, 24 bp, Artificial Sequence
  Synthetic Construct
gcagctgtttcagcgaatagttct

SEQ ID NO: 27235 - DNA, 24 bp, Artificial Sequence
  Synthetic Construct
acttgtgatgacaaagggaaggaa

SEQ ID NO: 27236 - DNA, 20 bp, Artificial Sequence
  Synthetic Construct
acagacggtggcgtcatcaa

SEQ ID NO: 27237 - DNA, 24 bp, Artificial Sequence
  Synthetic Construct
ctgggtgtgtagtgcagtcagttc

SEQ ID NO: 27238 - DNA, 21 bp, Artificial Sequence
  Synthetic Construct
tccctccagagcttcacagaa

SEQ ID NO: 27239 - DNA, 23 bp, Artificial Sequence
  Synthetic Construct
tgaggctcagacagatgatgttg

SEQ ID NO: 27240 - DNA, 21 bp, Artificial Sequence
  Synthetic Construct
agggacccgtttcagttcatc

SEQ ID NO: 27241 - DNA, 24 bp, Artificial Sequence
  Synthetic Construct
cccctttgatgccacagttatttc

SEQ ID NO: 27242 - DNA, 24 bp, Artificial Sequence
  Synthetic Construct
ccagactatgccacagggctaatg

SEQ ID NO: 27243 - DNA, 19 bp, Artificial Sequence
  Synthetic Construct
ttgcctttgcccgcacatc

SEQ ID NO: 27244 - DNA, 20 bp, Artificial Sequence
  Synthetic Construct
aggaccacgggctgcaggta

SEQ ID NO: 27245 - DNA, 20 bp, Artificial Sequence
  Synthetic Construct
tgtgcccagggttgcacata

SEQ ID NO: 27246 - DNA, 22 bp, Artificial Sequence
  Synthetic Construct
ccttgctgatccaggcaaaatg

SEQ ID NO: 27247 - DNA, 22 bp, Artificial Sequence
  Synthetic Construct
ccttcactcctgggtgaggaat

SEQ ID NO: 27248 - DNA, 25 bp, Artificial Sequence
  Synthetic Construct
gtagattagcatgagtgggaactga

SEQ ID NO: 27249 - DNA, 21 bp, Artificial Sequence
  Synthetic Construct
agttcctccaggaaggtgcta

SEQ ID NO: 27250 - DNA, 21 bp, Artificial Sequence
  Synthetic Construct
atgccggtggggtttatgaat

SEQ ID NO: 27251 - DNA, 21 bp, Artificial Sequence
  Synthetic Construct
cggagcaccaccaggattgtt

SEQ ID NO: 27252 - DNA, 22 bp, Artificial Sequence
  Synthetic Construct
cttgccatgtgccaagttctga

SEQ ID NO: 27253 - DNA, 21 bp, Artificial Sequence
  Synthetic Construct
tctcgcccactgtcaccatga

SEQ ID NO: 27254 - DNA, 22 bp, Artificial Sequence
  Synthetic Construct
caccaggcccttgtactcagat

SEQ ID NO: 27255 - DNA, 22 bp, Artificial Sequence
  Synthetic Construct
cacattgggacccaggactaag

SEQ ID NO: 27256 - DNA, 22 bp, Artificial Sequence
  Synthetic Construct
gtacagccccaaacatgactct

SEQ ID NO: 27257 - DNA, 21 bp, Artificial Sequence
  Synthetic Construct
gcgtagtccaggccctagaga

SEQ ID NO: 27258 - DNA, 22 bp, Artificial Sequence
  Synthetic Construct
ccccagcctaaggtttgtcctt

SEQ ID NO: 27259 - DNA, 21 bp, Artificial Sequence
  Synthetic Construct
ccctacccacaccacacaaaa

SEQ ID NO: 27260 - DNA, 22 bp, Artificial Sequence
  Synthetic Construct
ccctccgcaaggggaaatgaaa

SEQ ID NO: 27261 - DNA, 23 bp, Artificial Sequence
  Synthetic Construct
ccagatgagctcccaggactttg

SEQ ID NO: 27262 - DNA, 22 bp, Artificial Sequence
  Synthetic Construct
tggtggacaggagtgggaagtt

SEQ ID NO: 27263 - DNA, 25 bp, Artificial Sequence
  Synthetic Construct
gttttcctccaccccttttctcttc

SEQ ID NO: 27264 - DNA, 22 bp, Artificial Sequence
  Synthetic Construct
cctgcctctcgccatactcatc

SEQ ID NO: 27265 - DNA, 22 bp, Artificial Sequence
  Synthetic Construct
cgcacaccctattgggaaggaa

SEQ ID NO: 27266 - DNA, 24 bp, Artificial Sequence
  Synthetic Construct
cctctgctagtctcctgaatgttg

SEQ ID NO: 27267 - DNA, 19 bp, Artificial Sequence
  Synthetic Construct
gccgcagtggctgatccat

SEQ ID NO: 27268 - DNA, 24 bp, Artificial Sequence
  Synthetic Construct
agttgagaagcagggacttgaatc

SEQ ID NO: 27269 - DNA, 23 bp, Artificial Sequence
  Synthetic Construct
tgattttcccagggtctgtgtct

SEQ ID NO: 27270 - DNA, 22 bp, Artificial Sequence
  Synthetic Construct
cagccactcactgaccttgaca

SEQ ID NO: 27271 - DNA, 19 bp, Artificial Sequence
  Synthetic Construct
aaagccggccaccccaaca

SEQ ID NO: 27272 - DNA, 21 bp, Artificial Sequence
  Synthetic Construct
agctcagccactccagacaag

SEQ ID NO: 27273 - DNA, 23 bp, Artificial Sequence
  Synthetic Construct
aatcaccatgttaccaccaccat

SEQ ID NO: 27274 - DNA, 20 bp, Artificial Sequence
  Synthetic Construct
gcgtgggccagaaatcttca

SEQ ID NO: 27275 - DNA, 23 bp, Artificial Sequence
  Synthetic Construct
tcagagattggatttcggtcgtt

SEQ ID NO: 27276 - DNA, 23 bp, Artificial Sequence
  Synthetic Construct
ggaggttgcctcctcttcctaag

SEQ ID NO: 27277 - DNA, 20 bp, Artificial Sequence
  Synthetic Construct
acagggcggtgctagcttga

SEQ ID NO: 27278 - DNA, 23 bp, Artificial Sequence
  Synthetic Construct
ccacccagtgcctgaaagtaaag

SEQ ID NO: 27279 - DNA, 20 bp, Artificial Sequence
  Synthetic Construct
cccatggctaccctcactct

SEQ ID NO: 27280 - DNA, 22 bp, Artificial Sequence
  Synthetic Construct
tgttgagatgaagccagcaaca

SEQ ID NO: 27281 - DNA, 20 bp, Artificial Sequence
  Synthetic Construct
aaggatggcaggaccagtgt

SEQ ID NO: 27282 - DNA, 24 bp, Artificial Sequence
  Synthetic Construct
caatgtaagccagtgacaaactgt

SEQ ID NO: 27283 - DNA, 20 bp, Artificial Sequence
  Synthetic Construct
ccggagctcagcagatttca

SEQ ID NO: 27284 - DNA, 21 bp, Artificial Sequence
  Synthetic Construct
gggacaggctgcgacactatg

SEQ ID NO: 27285 - DNA, 20 bp, Artificial Sequence
  Synthetic Construct
acgtgggtgacaccagatga

SEQ ID NO: 27286 - DNA, 21 bp, Artificial Sequence
  Synthetic Construct
aagccaccgaggcctaactct

SEQ ID NO: 27287 - DNA, 21 bp, Artificial Sequence
  Synthetic Construct
ggccaactccctctccctaca

SEQ ID NO: 27288 - DNA, 20 bp, Artificial Sequence
  Synthetic Construct
aggcccaggcaagaaggaaa

SEQ ID NO: 27289 - DNA, 19 bp, Artificial Sequence
  Synthetic Construct
agcccacgatctgcaggaa

SEQ ID NO: 27290 - DNA, 21 bp, Artificial Sequence
  Synthetic Construct
ggtgccaccccagaaatcaca

SEQ ID NO: 27291 - DNA, 22 bp, Artificial Sequence
  Synthetic Construct
gccatccttacagcaggcttag

SEQ ID NO: 27292 - DNA, 21 bp, Artificial Sequence
  Synthetic Construct
tcctgcacacctcctggacaa

SEQ ID NO: 27293 - DNA, 26 bp, Artificial Sequence
  Synthetic Construct
gaatcataccttggctttgaggtaga

SEQ ID NO: 27294 - DNA, 19 bp, Artificial Sequence
  Synthetic Construct
tccctgcatgcccgaattt

SEQ ID NO: 27295 - DNA, 20 bp, Artificial Sequence
  Synthetic Construct
accatggcgcctgcaaaaag

SEQ ID NO: 27296 - DNA, 22 bp, Artificial Sequence
  Synthetic Construct
agagggactcaggcatctggaa

SEQ ID NO: 27297 - DNA, 19 bp, Artificial Sequence
  Synthetic Construct
cagccagcccttcaacagt

SEQ ID NO: 27298 - DNA, 23 bp, Artificial Sequence
  Synthetic Construct
ctgaccagggctgttttctgaag

SEQ ID NO: 27299 - DNA, 23 bp, Artificial Sequence
  Synthetic Construct
agagaataaacgcatgcggaaga

SEQ ID NO: 27300 - DNA, 20 bp, Artificial Sequence
  Synthetic Construct
tggagttcctccacgcattg

SEQ ID NO: 27301 - DNA, 21 bp, Artificial Sequence
  Synthetic Construct
cgtggcccaaccacagagatt

SEQ ID NO: 27302 - DNA, 22 bp, Artificial Sequence
  Synthetic Construct
cttcctgtccaccagcttcttc

SEQ ID NO: 27303 - DNA, 20 bp, Artificial Sequence
  Synthetic Construct
accgcgccttgctgtatcat

SEQ ID NO: 27304 - DNA, 22 bp, Artificial Sequence
  Synthetic Construct
cagaattcccggacagcacaga

SEQ ID NO: 27305 - DNA, 23 bp, Artificial Sequence
  Synthetic Construct
cattcctcaacctctcagaccaa

SEQ ID NO: 27306 - DNA, 27 bp, Artificial Sequence
  Synthetic Construct
gagttagagatcaagtggggagattac

SEQ ID NO: 27307 - DNA, 23 bp, Artificial Sequence
  Synthetic Construct
aagatgtgacggttggtacagtt

SEQ ID NO: 27308 - DNA, 24 bp, Artificial Sequence
  Synthetic Construct
ccaaattccaacctgaccctggta

SEQ ID NO: 27309 - DNA, 20 bp, Artificial Sequence
  Synthetic Construct
tgcccaaatccaggctgaag

SEQ ID NO: 27310 - DNA, 24 bp, Artificial Sequence
  Synthetic Construct
tcctctaaggtgaaatcgctcaaa

SEQ ID NO: 27311 - DNA, 20 bp, Artificial Sequence
  Synthetic Construct
aatggcctggggcaaagatg

SEQ ID NO: 27312 - DNA, 25 bp, Artificial Sequence
  Synthetic Construct
gaagctgaataatttgcccatcctt

SEQ ID NO: 27313 - DNA, 30 bp, Artificial Sequence
  Synthetic Construct
caggtcttttaccaagagagttttgctttc

SEQ ID NO: 27314 - DNA, 22 bp, Artificial Sequence
  Synthetic Construct
actgacagagctggatgcaaac

SEQ ID NO: 27315 - DNA, 21 bp, Artificial Sequence
  Synthetic Construct
acagccttaagcgccaagaag

SEQ ID NO: 27316 - DNA, 22 bp, Artificial Sequence
  Synthetic Construct
ggcaggagctgtgtcttgaatc

SEQ ID NO: 27317 - DNA, 21 bp, Artificial Sequence
  Synthetic Construct
ggccaacctggctggatttga

SEQ ID NO: 27318 - DNA, 19 bp, Artificial Sequence
  Synthetic Construct
tcacggtgcagaggagaca

SEQ ID NO: 27319 - DNA, 22 bp, Artificial Sequence
  Synthetic Construct
acaatggccacaattcctcaca

SEQ ID NO: 27320 - DNA, 22 bp, Artificial Sequence
  Synthetic Construct
gcctaggttttcactggaccat

SEQ ID NO: 27321 - DNA, 21 bp, Artificial Sequence
  Synthetic Construct
gctagggaccctcccgtatga

SEQ ID NO: 27322 - DNA, 19 bp, Artificial Sequence
  Synthetic Construct
agcctgggcctgtttctca

SEQ ID NO: 27323 - DNA, 22 bp, Artificial Sequence
  Synthetic Construct
gagcaaacccttggctcctagt

SEQ ID NO: 27324 - DNA, 22 bp, Artificial Sequence
  Synthetic Construct
ctcctcattccaccaccctctt

SEQ ID NO: 27325 - DNA, 22 bp, Artificial Sequence
  Synthetic Construct
gccctgtccaatgagtgacctt

SEQ ID NO: 27326 - DNA, 20 bp, Artificial Sequence
  Synthetic Construct
ccacagctccctgtcactca

SEQ ID NO: 27327 - DNA, 23 bp, Artificial Sequence
  Synthetic Construct
tgcaaataccccatagccagatg

SEQ ID NO: 27328 - DNA, 22 bp, Artificial Sequence
  Synthetic Construct
gcaagatctgcctccgctaaag

SEQ ID NO: 27329 - DNA, 24 bp, Artificial Sequence
  Synthetic Construct
ccccttcagtatcggccaaggtaa

SEQ ID NO: 27330 - DNA, 19 bp, Artificial Sequence
  Synthetic Construct
cagcctggaccctgtggat

SEQ ID NO: 27331 - DNA, 24 bp, Artificial Sequence
  Synthetic Construct
cagtcactgggagtttgactcatc

SEQ ID NO: 27332 - DNA, 21 bp, Artificial Sequence
  Synthetic Construct
tctgaggagctcaccttcctt

SEQ ID NO: 27333 - DNA, 23 bp, Artificial Sequence
  Synthetic Construct
gggttggacacctttctgctgtt

SEQ ID NO: 27334 - DNA, 22 bp, Artificial Sequence
  Synthetic Construct
tggggccatacctgtcttgtga

SEQ ID NO: 27335 - DNA, 21 bp, Artificial Sequence
  Synthetic Construct
ccaagtgcgtcgctcctttac

SEQ ID NO: 27336 - DNA, 21 bp, Artificial Sequence
  Synthetic Construct
gcacctgggcttcgtggtaat

SEQ ID NO: 27337 - DNA, 25 bp, Artificial Sequence
  Synthetic Construct
gttacacagtgcagggagatttaga

SEQ ID NO: 27338 - DNA, 25 bp, Artificial Sequence
  Synthetic Construct
gttctggaaaaatctggccttcttc

SEQ ID NO: 27339 - DNA, 20 bp, Artificial Sequence
  Synthetic Construct
agacggtgacaatgcccaat

SEQ ID NO: 27340 - DNA, 21 bp, Artificial Sequence
  Synthetic Construct
tgcctcgcctaactgggagat

SEQ ID NO: 27341 - DNA, 23 bp, Artificial Sequence
  Synthetic Construct
atggaggcagtggttacttttca

SEQ ID NO: 27342 - DNA, 20 bp, Artificial Sequence
  Synthetic Construct
gtgctgtgggtgagcacagt

SEQ ID NO: 27343 - DNA, 21 bp, Artificial Sequence
  Synthetic Construct
tggatgtgtcatgcccagttc

SEQ ID NO: 27344 - DNA, 19 bp, Artificial Sequence
  Synthetic Construct
tggcccaggatcgaccaat

SEQ ID NO: 27345 - DNA, 21 bp, Artificial Sequence
  Synthetic Construct
gtcaacccaggcgagacattc

SEQ ID NO: 27346 - DNA, 21 bp, Artificial Sequence
  Synthetic Construct
ggtgattgggtggcccttaga

SEQ ID NO: 27347 - DNA, 22 bp, Artificial Sequence
  Synthetic Construct
ggcagctgtgagaagtgatgat

SEQ ID NO: 27348 - DNA, 20 bp, Artificial Sequence
  Synthetic Construct
cccagcagcacctcaaggat

SEQ ID NO: 27349 - DNA, 21 bp, Artificial Sequence
  Synthetic Construct
aggggctcctgctaacaccat

SEQ ID NO: 27350 - DNA, 19 bp, Artificial Sequence
  Synthetic Construct
ccgccccgcatttccctaa

SEQ ID NO: 27351 - DNA, 22 bp, Artificial Sequence
  Synthetic Construct
ggttgaaaggggctctctaaca

SEQ ID NO: 27352 - DNA, 22 bp, Artificial Sequence
  Synthetic Construct
tggtgcacctgatgaacaaaca

SEQ ID NO: 27353 - DNA, 23 bp, Artificial Sequence
  Synthetic Construct
gccaaagctgtgaatgggtcttc

SEQ ID NO: 27354 - DNA, 19 bp, Artificial Sequence
  Synthetic Construct
gagaggccgcttgctcagt

SEQ ID NO: 27355 - DNA, 25 bp, Artificial Sequence
  Synthetic Construct
gatgaaatgagctgctttactcgtt

SEQ ID NO: 27356 - DNA, 18 bp, Artificial Sequence
  Synthetic Construct
agccctgtggcccatttg

SEQ ID NO: 27357 - DNA, 20 bp, Artificial Sequence
  Synthetic Construct
tggtctcccacttggactga

SEQ ID NO: 27358 - DNA, 24 bp, Artificial Sequence
  Synthetic Construct
gagggatccacttccagagtgaac

SEQ ID NO: 27359 - DNA, 24 bp, Artificial Sequence
  Synthetic Construct
agaaccacagcgatgatgatgtta

SEQ ID NO: 27360 - DNA, 19 bp, Artificial Sequence
  Synthetic Construct
agggagggctggcttaact

SEQ ID NO: 27361 - DNA, 19 bp, Artificial Sequence
  Synthetic Construct
ccaggcggggaagacaact

SEQ ID NO: 27362 - DNA, 22 bp, Artificial Sequence
  Synthetic Construct
gcctatggtagtctccccacat

SEQ ID NO: 27363 - DNA, 22 bp, Artificial Sequence
  Synthetic Construct
gcgagagctcctgcaaccttat

SEQ ID NO: 27364 - DNA, 20 bp, Artificial Sequence
  Synthetic Construct
ggacgtggcaccatgagttg

SEQ ID NO: 27365 - DNA, 22 bp, Artificial Sequence
  Synthetic Construct
tacgccccgacgtgctagaaaa

SEQ ID NO: 27366 - DNA, 22 bp, Artificial Sequence
  Synthetic Construct
agtagggccatgtgactgagtt

SEQ ID NO: 27367 - DNA, 22 bp, Artificial Sequence
  Synthetic Construct
catcaagcctgaacgaagcaaa

SEQ ID NO: 27368 - DNA, 20 bp, Artificial Sequence
  Synthetic Construct
ctctgcacagcacagggaat

SEQ ID NO: 27369 - DNA, 28 bp, Artificial Sequence
  Synthetic Construct
cgaagcctatccatttccacttagtagt

SEQ ID NO: 27370 - DNA, 20 bp, Artificial Sequence
  Synthetic Construct
cgggatgcgactcgacgaaa

SEQ ID NO: 27371 - DNA, 20 bp, Artificial Sequence
  Synthetic Construct
tggctaggcagtgactcaga

SEQ ID NO: 27372 - DNA, 20 bp, Artificial Sequence
  Synthetic Construct
tgccgtacctgggaatccat

SEQ ID NO: 27373 - DNA, 25 bp, Artificial Sequence
  Synthetic Construct
gagtcagaaaggatgacctggagta

SEQ ID NO: 27374 - DNA, 25 bp, Artificial Sequence
  Synthetic Construct
ctgctctgaatggaacaggaaggaa

SEQ ID NO: 27375 - DNA, 22 bp, Artificial Sequence
  Synthetic Construct
ggagggaaggctttgcttctca

SEQ ID NO: 27376 - DNA, 19 bp, Artificial Sequence
  Synthetic Construct
gtgcccatctgccggatct

SEQ ID NO: 27377 - DNA, 21 bp, Artificial Sequence
  Synthetic Construct
ccctagccaggtgctgtttgt

SEQ ID NO: 27378 - DNA, 20 bp, Artificial Sequence
  Synthetic Construct
tggtgctggagtgggagtga

SEQ ID NO: 27379 - DNA, 22 bp, Artificial Sequence
  Synthetic Construct
cagctcagtctgaagtgcaaga

SEQ ID NO: 27380 - DNA, 21 bp, Artificial Sequence
  Synthetic Construct
aaggagcagggacctaaggaa

SEQ ID NO: 27381 - DNA, 19 bp, Artificial Sequence
  Synthetic Construct
aggcctggctcctgcatca

SEQ ID NO: 27382 - DNA, 21 bp, Artificial Sequence
  Synthetic Construct
ttggagtgggtctggaaggat

SEQ ID NO: 27383 - DNA, 19 bp, Artificial Sequence
  Synthetic Construct
caggccagacagcctttgt

SEQ ID NO: 27384 - DNA, 21 bp, Artificial Sequence
  Synthetic Construct
tgctggccaaggagacagatg

SEQ ID NO: 27385 - DNA, 24 bp, Artificial Sequence
  Synthetic Construct
gcattcgaccttaggtttggaaag

SEQ ID NO: 27386 - DNA, 23 bp, Artificial Sequence
  Synthetic Construct
ggtgccagtggactatctctaca

SEQ ID NO: 27387 - DNA, 21 bp, Artificial Sequence
  Synthetic Construct
gcctcacacttgggacacaaa

SEQ ID NO: 27388 - DNA, 19 bp, Artificial Sequence
  Synthetic Construct
aagccttcgcactcagctt

SEQ ID NO: 27389 - DNA, 23 bp, Artificial Sequence
  Synthetic Construct
cgttccatgagccagactcttct

SEQ ID NO: 27390 - DNA, 21 bp, Artificial Sequence
  Synthetic Construct
cttgccacctagcccaaatgt

SEQ ID NO: 27391 - DNA, 21 bp, Artificial Sequence
  Synthetic Construct
cagccccgaacagagttttga

SEQ ID NO: 27392 - DNA, 22 bp, Artificial Sequence
  Synthetic Construct
gcactactgtcaggctgcaatc

SEQ ID NO: 27393 - DNA, 20 bp, Artificial Sequence
  Synthetic Construct
tccagcggaccctgaaggaa

SEQ ID NO: 27394 - DNA, 22 bp, Artificial Sequence
  Synthetic Construct
ccctcccatggcctttctatca

SEQ ID NO: 27395 - DNA, 21 bp, Artificial Sequence
  Synthetic Construct
gccatcctcaggagcgtgaat

SEQ ID NO: 27396 - DNA, 25 bp, Artificial Sequence
  Synthetic Construct
gcaaggacagcttagtgattaggta

SEQ ID NO: 27397 - DNA, 20 bp, Artificial Sequence
  Synthetic Construct
aggcccctgtctccaactca

SEQ ID NO: 27398 - DNA, 25 bp, Artificial Sequence
  Synthetic Construct
ggaagtcagcatcaaacccttgact

SEQ ID NO: 27399 - DNA, 22 bp, Artificial Sequence
  Synthetic Construct
ggccagccctagtgaagaaaac

SEQ ID NO: 27400 - DNA, 22 bp, Artificial Sequence
  Synthetic Construct
tctgcatcaggccctctaagat

SEQ ID NO: 27401 - DNA, 22 bp, Artificial Sequence
  Synthetic Construct
tccctgcctgaatgttggaaac

SEQ ID NO: 27402 - DNA, 19 bp, Artificial Sequence
  Synthetic Construct
cgcagcgacagcagtcaga

SEQ ID NO: 27403 - DNA, 20 bp, Artificial Sequence
  Synthetic Construct
tgaagtgccgagccctgtga

SEQ ID NO: 27404 - DNA, 22 bp, Artificial Sequence
  Synthetic Construct
tgtgcacaccatgtcaccatag

SEQ ID NO: 27405 - DNA, 19 bp, Artificial Sequence
  Synthetic Construct
ttccctctcccggcaacat

SEQ ID NO: 27406 - DNA, 22 bp, Artificial Sequence
  Synthetic Construct
gaggtggagaacgtgagacact

SEQ ID NO: 27407 - DNA, 20 bp, Artificial Sequence
  Synthetic Construct
ggtagggctggctggaggaa

SEQ ID NO: 27408 - DNA, 23 bp, Artificial Sequence
  Synthetic Construct
agtagtgcctctgtcttctgtga

SEQ ID NO: 27409 - DNA, 26 bp, Artificial Sequence
  Synthetic Construct
ctggaggagaggtaaagagaggtaaa

SEQ ID NO: 27410 - DNA, 21 bp, Artificial Sequence
  Synthetic Construct
ccagagcaccattccccatag

SEQ ID NO: 27411 - DNA, 24 bp, Artificial Sequence
  Synthetic Construct
gctgtcatgccttgcttcagattg

SEQ ID NO: 27412 - DNA, 22 bp, Artificial Sequence
  Synthetic Construct
ggatgggctcgggacttcctaa

SEQ ID NO: 27413 - DNA, 24 bp, Artificial Sequence
  Synthetic Construct
gccagtgtcaggacttgttcattc

SEQ ID NO: 27414 - DNA, 20 bp, Artificial Sequence
  Synthetic Construct
ggcacacggccaaattcaga

SEQ ID NO: 27415 - DNA, 21 bp, Artificial Sequence
  Synthetic Construct
cgacggatgaggcaggtgttt

SEQ ID NO: 27416 - DNA, 20 bp, Artificial Sequence
  Synthetic Construct
tggcagcaccctttgggttt

SEQ ID NO: 27417 - DNA, 21 bp, Artificial Sequence
  Synthetic Construct
ccctcgttccctgcaatgtca

SEQ ID NO: 27418 - DNA, 20 bp, Artificial Sequence
  Synthetic Construct
gccaggaggtggaggtatga

SEQ ID NO: 27419 - DNA, 25 bp, Artificial Sequence
  Synthetic Construct
cccagtagttgaggtcttccacaat

SEQ ID NO: 27420 - DNA, 25 bp, Artificial Sequence
  Synthetic Construct
acaaaaccctgaagaatcccagtat

SEQ ID NO: 27421 - DNA, 22 bp, Artificial Sequence
  Synthetic Construct
gtaggcctcctggagtgggtat

SEQ ID NO: 27422 - DNA, 22 bp, Artificial Sequence
  Synthetic Construct
ctgattaggtcctgccgtcctt

SEQ ID NO: 27423 - DNA, 23 bp, Artificial Sequence
  Synthetic Construct
cccattggctgaaataggggaaa

SEQ ID NO: 27424 - DNA, 20 bp, Artificial Sequence
  Synthetic Construct
gccctcctggtgtttgtgaa

SEQ ID NO: 27425 - DNA, 21 bp, Artificial Sequence
  Synthetic Construct
ccaagcccttcagccagttca

SEQ ID NO: 27426 - DNA, 20 bp, Artificial Sequence
  Synthetic Construct
tcctcacacccttggctgat

SEQ ID NO: 27427 - DNA, 22 bp, Artificial Sequence
  Synthetic Construct
tgttcccagaggacagggacaa

SEQ ID NO: 27428 - DNA, 22 bp, Artificial Sequence
  Synthetic Construct
ggccaagcccttacctgaagat

SEQ ID NO: 27429 - DNA, 24 bp, Artificial Sequence
  Synthetic Construct
ctcacccttccgaactcttaacat

SEQ ID NO: 27430 - DNA, 21 bp, Artificial Sequence
  Synthetic Construct
aatcgacacgcccattactgt

SEQ ID NO: 27431 - DNA, 20 bp, Artificial Sequence
  Synthetic Construct
tccacagggctcccgtgaca

SEQ ID NO: 27432 - DNA, 24 bp, Artificial Sequence
  Synthetic Construct
tgtcctttctaggctgtctctgtt

SEQ ID NO: 27433 - DNA, 21 bp, Artificial Sequence
  Synthetic Construct
tggccccactcccaacaaaag

SEQ ID NO: 27434 - DNA, 20 bp, Artificial Sequence
  Synthetic Construct
tgcggtcagacgggctcaga

SEQ ID NO: 27435 - DNA, 21 bp, Artificial Sequence
  Synthetic Construct
agttcccctgggttgcagagt

SEQ ID NO: 27436 - DNA, 21 bp, Artificial Sequence
  Synthetic Construct
catccactgctgcgctttttg

SEQ ID NO: 27437 - DNA, 21 bp, Artificial Sequence
  Synthetic Construct
gcaaggctggtctctctgctt

SEQ ID NO: 27438 - DNA, 23 bp, Artificial Sequence
  Synthetic Construct
cgtcccaggaggtggaaatcatc

SEQ ID NO: 27439 - DNA, 21 bp, Artificial Sequence
  Synthetic Construct
gcaatcttcccacctcagctt

SEQ ID NO: 27440 - DNA, 19 bp, Artificial Sequence
  Synthetic Construct
gggcgctgccatctccttt

SEQ ID NO: 27441 - DNA, 23 bp, Artificial Sequence
  Synthetic Construct
acactggtcaggtatggatcact

SEQ ID NO: 27442 - DNA, 22 bp, Artificial Sequence
  Synthetic Construct
ccagagccacctggagtaggta

SEQ ID NO: 27443 - DNA, 23 bp, Artificial Sequence
  Synthetic Construct
catcgctaagtcatggtgtcact

SEQ ID NO: 27444 - DNA, 21 bp, Artificial Sequence
  Synthetic Construct
agggtggagcctcctcgtttt

SEQ ID NO: 27445 - DNA, 20 bp, Artificial Sequence
  Synthetic Construct
gaggacctcccctcctctga

SEQ ID NO: 27446 - DNA, 22 bp, Artificial Sequence
  Synthetic Construct
tggcttctctccccactgtgat

SEQ ID NO: 27447 - DNA, 26 bp, Artificial Sequence
  Synthetic Construct
gcctctaagtccattctttggatttg

SEQ ID NO: 27448 - DNA, 22 bp, Artificial Sequence
  Synthetic Construct
ggctgggcatggctgcttaata

SEQ ID NO: 27449 - DNA, 23 bp, Artificial Sequence
  Synthetic Construct
cctcagtcctcacagggagattc

SEQ ID NO: 27450 - DNA, 21 bp, Artificial Sequence
  Synthetic Construct
gtttgtctcctctcgccttca

SEQ ID NO: 27451 - DNA, 21 bp, Artificial Sequence
  Synthetic Construct
ccctgacctgtcctgggtcat

SEQ ID NO: 27452 - DNA, 19 bp, Artificial Sequence
  Synthetic Construct
gggcgtgcacccgaatgaa

SEQ ID NO: 27453 - DNA, 22 bp, Artificial Sequence
  Synthetic Construct
ctctgggagcagtgaaggttct

SEQ ID NO: 27454 - DNA, 22 bp, Artificial Sequence
  Synthetic Construct
aggaatggcctgggagcttttg

SEQ ID NO: 27455 - DNA, 21 bp, Artificial Sequence
  Synthetic Construct
tccgtcaccacagtggggttt

SEQ ID NO: 27456 - DNA, 19 bp, Artificial Sequence
  Synthetic Construct
agtgcagcgcagccctcta

SEQ ID NO: 27457 - DNA, 22 bp, Artificial Sequence
  Synthetic Construct
tgtcagggccttgtgggattct

SEQ ID NO: 27458 - DNA, 25 bp, Artificial Sequence
  Synthetic Construct
cgacgaaaccaagagcaaagtgaac

SEQ ID NO: 27459 - DNA, 20 bp, Artificial Sequence
  Synthetic Construct
gcagcagcccctggaatgta

SEQ ID NO: 27460 - DNA, 21 bp, Artificial Sequence
  Synthetic Construct
aagtgccccagcaagctgtca

SEQ ID NO: 27461 - DNA, 22 bp, Artificial Sequence
  Synthetic Construct
tcccagtggtctcttggcttga

SEQ ID NO: 27462 - DNA, 21 bp, Artificial Sequence
  Synthetic Construct
tcacagggtcacacggagtca

SEQ ID NO: 27463 - DNA, 20 bp, Artificial Sequence
  Synthetic Construct
ggtcgcatgtcaccctgtgt

SEQ ID NO: 27464 - DNA, 25 bp, Artificial Sequence
  Synthetic Construct
ggtaccaaccgatgtctctttgcat

SEQ ID NO: 27465 - DNA, 22 bp, Artificial Sequence
  Synthetic Construct
gtcacatgcccacccacaatac

SEQ ID NO: 27466 - DNA, 21 bp, Artificial Sequence
  Synthetic Construct
tcgttcccgactgtggtgagt

SEQ ID NO: 27467 - DNA, 21 bp, Artificial Sequence
  Synthetic Construct
gctgctgggaagctctgtttg

SEQ ID NO: 27468 - DNA, 20 bp, Artificial Sequence
  Synthetic Construct
tggagctgctgccctgttag

SEQ ID NO: 27469 - DNA, 22 bp, Artificial Sequence
  Synthetic Construct
ccaaccagcctgatggtctctt

SEQ ID NO: 27470 - DNA, 22 bp, Artificial Sequence
  Synthetic Construct
catatggattcgctgccggtaa

SEQ ID NO: 27471 - DNA, 22 bp, Artificial Sequence
  Synthetic Construct
gcatcaaaccaaaccagacaca

SEQ ID NO: 27472 - DNA, 22 bp, Artificial Sequence
  Synthetic Construct
gaggcagggccagataaattct

SEQ ID NO: 27473 - DNA, 21 bp, Artificial Sequence
  Synthetic Construct
aggctgtccaagagtccaaga

SEQ ID NO: 27474 - DNA, 19 bp, Artificial Sequence
  Synthetic Construct
gcacaggcctggagagcaa

SEQ ID NO: 27475 - DNA, 22 bp, Artificial Sequence
  Synthetic Construct
ggttggttgcctcttgttccat

SEQ ID NO: 27476 - DNA, 20 bp, Artificial Sequence
  Synthetic Construct
gagcagtgtgtgctgtggat

SEQ ID NO: 27477 - DNA, 22 bp, Artificial Sequence
  Synthetic Construct
cggcatccaatctgctcttagt

SEQ ID NO: 27478 - DNA, 23 bp, Artificial Sequence
  Synthetic Construct
atgaagaagagcgggaaaaggat

SEQ ID NO: 27479 - DNA, 21 bp, Artificial Sequence
  Synthetic Construct
cccaaggtcgtcgctacttgt

SEQ ID NO: 27480 - DNA, 19 bp, Artificial Sequence
  Synthetic Construct
tgggcagcgctctgcttct

SEQ ID NO: 27481 - DNA, 22 bp, Artificial Sequence
  Synthetic Construct
tcccctcccagctacagaaact

SEQ ID NO: 27482 - DNA, 24 bp, Artificial Sequence
  Synthetic Construct
cctagaagtacgtacccaccaaca

SEQ ID NO: 27483 - DNA, 22 bp, Artificial Sequence
  Synthetic Construct
tggaggagaaggtggctgtttg

SEQ ID NO: 27484 - DNA, 22 bp, Artificial Sequence
  Synthetic Construct
gggaacggtagtgaggatgaag

SEQ ID NO: 27485 - DNA, 21 bp, Artificial Sequence
  Synthetic Construct
ctttcccagcctcgattgcat

SEQ ID NO: 27486 - DNA, 22 bp, Artificial Sequence
  Synthetic Construct
cacagtggcaggcacctgtaat

SEQ ID NO: 27487 - DNA, 21 bp, Artificial Sequence
  Synthetic Construct
gcagggagaagctcccctaga

SEQ ID NO: 27488 - DNA, 22 bp, Artificial Sequence
  Synthetic Construct
actgagggaatgaggactggat

SEQ ID NO: 27489 - DNA, 19 bp, Artificial Sequence
  Synthetic Construct
ggcaacgcaggcaaagtgt

SEQ ID NO: 27490 - DNA, 21 bp, Artificial Sequence
  Synthetic Construct
ggctcccctctcagagcaaaa

SEQ ID NO: 27491 - DNA, 23 bp, Artificial Sequence
  Synthetic Construct
ggactggagtctgttgggagaga

SEQ ID NO: 27492 - DNA, 22 bp, Artificial Sequence
  Synthetic Construct
gacggctccgtctgttgagaaa

SEQ ID NO: 27493 - DNA, 24 bp, Artificial Sequence
  Synthetic Construct
gcacctttgccttaagcatcattg

SEQ ID NO: 27494 - DNA, 25 bp, Artificial Sequence
  Synthetic Construct
agggataacatgtctcgttcaactt

SEQ ID NO: 27495 - DNA, 21 bp, Artificial Sequence
  Synthetic Construct
cagcgtgcactgtctgagtct

SEQ ID NO: 27496 - DNA, 20 bp, Artificial Sequence
  Synthetic Construct
agctgtgggtttccgtgtgt

SEQ ID NO: 27497 - DNA, 23 bp, Artificial Sequence
  Synthetic Construct
gagggaagcccagcattatgaag

SEQ ID NO: 27498 - DNA, 23 bp, Artificial Sequence
  Synthetic Construct
cctctcctgtcttcgtagtgaga

SEQ ID NO: 27499 - DNA, 23 bp, Artificial Sequence
  Synthetic Construct
gcttgagctgggttattgtgttc

SEQ ID NO: 27500 - DNA, 21 bp, Artificial Sequence
  Synthetic Construct
tcttccttgggcgtgggaatg

SEQ ID NO: 27501 - DNA, 21 bp, Artificial Sequence
  Synthetic Construct
ggctgagcctcacagtaacaa

SEQ ID NO: 27502 - DNA, 22 bp, Artificial Sequence
  Synthetic Construct
cagggacacaaaaccccgatca

SEQ ID NO: 27503 - DNA, 20 bp, Artificial Sequence
  Synthetic Construct
tgggcctaggaaggttcagt

SEQ ID NO: 27504 - DNA, 20 bp, Artificial Sequence
  Synthetic Construct
cgcgatgacatggaggtgaa

SEQ ID NO: 27505 - DNA, 23 bp, Artificial Sequence
  Synthetic Construct
acatcctcaatcacagactgctt

SEQ ID NO: 27506 - DNA, 21 bp, Artificial Sequence
  Synthetic Construct
tctccacagggtcctgctcaa

SEQ ID NO: 27507 - DNA, 22 bp, Artificial Sequence
  Synthetic Construct
cagactctctgcacctcagtgt

SEQ ID NO: 27508 - DNA, 24 bp, Artificial Sequence
  Synthetic Construct
gctgcttccacattacgtttgaga

SEQ ID NO: 27509 - DNA, 20 bp, Artificial Sequence
  Synthetic Construct
ctggtccagcctgggagttg

SEQ ID NO: 27510 - DNA, 19 bp, Artificial Sequence
  Synthetic Construct
tgcggtggacaagggaagt

SEQ ID NO: 27511 - DNA, 22 bp, Artificial Sequence
  Synthetic Construct
ccggcctggagggatattcttg

SEQ ID NO: 27512 - DNA, 19 bp, Artificial Sequence
  Synthetic Construct
tcctgcagccaagctcaca

SEQ ID NO: 27513 - DNA, 21 bp, Artificial Sequence
  Synthetic Construct
gcctccaggactttgaaccaa

SEQ ID NO: 27514 - DNA, 24 bp, Artificial Sequence
  Synthetic Construct
gatggcaagatcctgtctctacaa

SEQ ID NO: 27515 - DNA, 21 bp, Artificial Sequence
  Synthetic Construct
acacacagggagaggccgttt

SEQ ID NO: 27516 - DNA, 20 bp, Artificial Sequence
  Synthetic Construct
tgagcgcagaccttcctgat

SEQ ID NO: 27517 - DNA, 18 bp, Artificial Sequence
  Synthetic Construct
gcgtccctcggcttgtaa

SEQ ID NO: 27518 - DNA, 20 bp, Artificial Sequence
  Synthetic Construct
tcccgcaggtgaagcctcta

SEQ ID NO: 27519 - DNA, 20 bp, Artificial Sequence
  Synthetic Construct
ggcctgaagcccgggatatt

SEQ ID NO: 27520 - DNA, 20 bp, Artificial Sequence
  Synthetic Construct
acgcgatgtcctggaaaaca

SEQ ID NO: 27521 - DNA, 24 bp, Artificial Sequence
  Synthetic Construct
cagtcacctgagtgaaagctaagt

SEQ ID NO: 27522 - DNA, 19 bp, Artificial Sequence
  Synthetic Construct
cccaatcccgcagctctca

SEQ ID NO: 27523 - DNA, 23 bp, Artificial Sequence
  Synthetic Construct
gccaacagcagagagagaacaga

SEQ ID NO: 27524 - DNA, 20 bp, Artificial Sequence
  Synthetic Construct
tctgcctgtccccagtcttg

SEQ ID NO: 27525 - DNA, 22 bp, Artificial Sequence
  Synthetic Construct
atgcctgggtctcttcctgaga

SEQ ID NO: 27526 - DNA, 20 bp, Artificial Sequence
  Synthetic Construct
ccctgtgggctcctggtaca

SEQ ID NO: 27527 - DNA, 21 bp, Artificial Sequence
  Synthetic Construct
ccaaacagctggccagtgaag

SEQ ID NO: 27528 - DNA, 20 bp, Artificial Sequence
  Synthetic Construct
tgggttcccatgtggtgtga

SEQ ID NO: 27529 - DNA, 20 bp, Artificial Sequence
  Synthetic Construct
aggagtggccagcagtgaaa

SEQ ID NO: 27530 - DNA, 22 bp, Artificial Sequence
  Synthetic Construct
gaggatgagtgcctgactgtgt

SEQ ID NO: 27531 - DNA, 20 bp, Artificial Sequence
  Synthetic Construct
ccgaacccacttgcccattg

SEQ ID NO: 27532 - DNA, 22 bp, Artificial Sequence
  Synthetic Construct
gtgcgctcggaaggttgaatag

SEQ ID NO: 27533 - DNA, 18 bp, Artificial Sequence
  Synthetic Construct
cacggctcactgcagctt

SEQ ID NO: 27534 - DNA, 23 bp, Artificial Sequence
  Synthetic Construct
ggctcttcagagtgatgggacat

SEQ ID NO: 27535 - DNA, 22 bp, Artificial Sequence
  Synthetic Construct
ttgtggagccccagtctctgaa

SEQ ID NO: 27536 - DNA, 24 bp, Artificial Sequence
  Synthetic Construct
gtcttactttctccgtcccagtag

SEQ ID NO: 27537 - DNA, 23 bp, Artificial Sequence
  Synthetic Construct
gtggtgacagaaagcagcacatc

SEQ ID NO: 27538 - DNA, 20 bp, Artificial Sequence
  Synthetic Construct
tcctccgagccactgctcat

SEQ ID NO: 27539 - DNA, 18 bp, Artificial Sequence
  Synthetic Construct
gccacaagcccgaccttt

SEQ ID NO: 27540 - DNA, 19 bp, Artificial Sequence
  Synthetic Construct
gccaccctacgtcctgtgt

SEQ ID NO: 27541 - DNA, 23 bp, Artificial Sequence
  Synthetic Construct
ggagtctgttgaaaaggctggtt

SEQ ID NO: 27542 - DNA, 22 bp, Artificial Sequence
  Synthetic Construct
gtccccagggaaaagccattgt

SEQ ID NO: 27543 - DNA, 20 bp, Artificial Sequence
  Synthetic Construct
aggggagatgcctgtgatga

SEQ ID NO: 27544 - DNA, 20 bp, Artificial Sequence
  Synthetic Construct
aggcaccagtgagctgatgt

SEQ ID NO: 27545 - DNA, 18 bp, Artificial Sequence
  Synthetic Construct
agaggtgggcagcactga

SEQ ID NO: 27546 - DNA, 19 bp, Artificial Sequence
  Synthetic Construct
cccggctgagagcagacaa

SEQ ID NO: 27547 - DNA, 20 bp, Artificial Sequence
  Synthetic Construct
cagctctcacctgcgttttg

SEQ ID NO: 27548 - DNA, 20 bp, Artificial Sequence
  Synthetic Construct
acagccgccttcccaaaaca

SEQ ID NO: 27549 - DNA, 24 bp, Artificial Sequence
  Synthetic Construct
cggtcactaggcaccatctaattc

SEQ ID NO: 27550 - DNA, 19 bp, Artificial Sequence
  Synthetic Construct
tggcacggccacgaacatc

SEQ ID NO: 27551 - DNA, 22 bp, Artificial Sequence
  Synthetic Construct
ggagtaaaccacctgcctctct

SEQ ID NO: 27552 - DNA, 24 bp, Artificial Sequence
  Synthetic Construct
ccaaccccaacagaacaagaccaa

SEQ ID NO: 27553 - DNA, 22 bp, Artificial Sequence
  Synthetic Construct
acaaacagccttccgtctcttc

SEQ ID NO: 27554 - DNA, 20 bp, Artificial Sequence
  Synthetic Construct
aaccacctggccctctgtag

SEQ ID NO: 27555 - DNA, 22 bp, Artificial Sequence
  Synthetic Construct
gggagagtgccctgtttgttgt

SEQ ID NO: 27556 - DNA, 22 bp, Artificial Sequence
  Synthetic Construct
gcgtttgcactgggagatgaag

SEQ ID NO: 27557 - DNA, 20 bp, Artificial Sequence
  Synthetic Construct
gcccacctgcatttggcttt

SEQ ID NO: 27558 - DNA, 19 bp, Artificial Sequence
  Synthetic Construct
cccaggtgccaggtgtcat

SEQ ID NO: 27559 - DNA, 22 bp, Artificial Sequence
  Synthetic Construct
cccgcctgattctgggagtttt

SEQ ID NO: 27560 - DNA, 19 bp, Artificial Sequence
  Synthetic Construct
ttgcggggtgtgcggagat

SEQ ID NO: 27561 - DNA, 19 bp, Artificial Sequence
  Synthetic Construct
cgggagctgctgcttgttg

SEQ ID NO: 27562 - DNA, 18 bp, Artificial Sequence
  Synthetic Construct
tcctgctccctggcacat

SEQ ID NO: 27563 - DNA, 22 bp, Artificial Sequence
  Synthetic Construct
ggtatggggagaggaccctgaa

SEQ ID NO: 27564 - DNA, 21 bp, Artificial Sequence
  Synthetic Construct
gcttgctggttggatgtcagt

SEQ ID NO: 27565 - DNA, 21 bp, Artificial Sequence
  Synthetic Construct
tgctctgtgggtgtcacattc

SEQ ID NO: 27566 - DNA, 22 bp, Artificial Sequence
  Synthetic Construct
gcccagagctccatttcactgt

SEQ ID NO: 27567 - DNA, 21 bp, Artificial Sequence
  Synthetic Construct
tgttcatggccaaaggtgtga

SEQ ID NO: 27568 - DNA, 22 bp, Artificial Sequence
  Synthetic Construct
cggccaggagaaccagaatctt

SEQ ID NO: 27569 - DNA, 20 bp, Artificial Sequence
  Synthetic Construct
gtgcgtgtgtggtgttctct

SEQ ID NO: 27570 - DNA, 23 bp, Artificial Sequence
  Synthetic Construct
gtacaagaattccgaccccaaga

SEQ ID NO: 27571 - DNA, 21 bp, Artificial Sequence
  Synthetic Construct
gtggttgggtgggcagataga

SEQ ID NO: 27572 - DNA, 21 bp, Artificial Sequence
  Synthetic Construct
cctactgcttgctgctagtgt

SEQ ID NO: 27573 - DNA, 22 bp, Artificial Sequence
  Synthetic Construct
caacggtaagactgaccagaca

SEQ ID NO: 27574 - DNA, 26 bp, Artificial Sequence
  Synthetic Construct
gtcttaggctagctagggcaatgtag

SEQ ID NO: 27575 - DNA, 22 bp, Artificial Sequence
  Synthetic Construct
gtgggatgccctttacacatca

SEQ ID NO: 27576 - DNA, 21 bp, Artificial Sequence
  Synthetic Construct
agcgcagtctgaatcaacagt

SEQ ID NO: 27577 - DNA, 21 bp, Artificial Sequence
  Synthetic Construct
tcttggctcccactcacaaac

SEQ ID NO: 27578 - DNA, 22 bp, Artificial Sequence
  Synthetic Construct
cccagcacttccctaagcagta

SEQ ID NO: 27579 - DNA, 20 bp, Artificial Sequence
  Synthetic Construct
gcctggcctctctcttctgt

SEQ ID NO: 27580 - DNA, 24 bp, Artificial Sequence
  Synthetic Construct
gagctctggaagcagcatctaagt

SEQ ID NO: 27581 - DNA, 24 bp, Artificial Sequence
  Synthetic Construct
tgatgcaaaacagaggaaggaaca

SEQ ID NO: 27582 - DNA, 22 bp, Artificial Sequence
  Synthetic Construct
gagtcagcgtcctgttcgttag

SEQ ID NO: 27583 - DNA, 23 bp, Artificial Sequence
  Synthetic Construct
gacgaaggttgggagtcagaaac

SEQ ID NO: 27584 - DNA, 25 bp, Artificial Sequence
  Synthetic Construct
cacaaggtaaaacaggcacttcctt

SEQ ID NO: 27585 - DNA, 24 bp, Artificial Sequence
  Synthetic Construct
gacagacccaaatttctgccacat

SEQ ID NO: 27586 - DNA, 20 bp, Artificial Sequence
  Synthetic Construct
ccaccgtgcccagtcacata

SEQ ID NO: 27587 - DNA, 24 bp, Artificial Sequence
  Synthetic Construct
ggaagagaaggtctaagcggaagt

SEQ ID NO: 27588 - DNA, 18 bp, Artificial Sequence
  Synthetic Construct
ctcgcagaccgtgcaact

SEQ ID NO: 27589 - DNA, 24 bp, Artificial Sequence
  Synthetic Construct
tgacttgcagctcatggaattttg

SEQ ID NO: 27590 - DNA, 20 bp, Artificial Sequence
  Synthetic Construct
atcgtggagactggctggat

SEQ ID NO: 27591 - DNA, 20 bp, Artificial Sequence
  Synthetic Construct
ctgaccgctagccctgttag

SEQ ID NO: 27592 - DNA, 20 bp, Artificial Sequence
  Synthetic Construct
gctgccaccatgacttctct

SEQ ID NO: 27593 - DNA, 20 bp, Artificial Sequence
  Synthetic Construct
ccccaggcagagccatatct

SEQ ID NO: 27594 - DNA, 24 bp, Artificial Sequence
  Synthetic Construct
cctctgtccatgcaatcccaagaa

SEQ ID NO: 27595 - DNA, 21 bp, Artificial Sequence
  Synthetic Construct
tggtggagccaacggatagat

SEQ ID NO: 27596 - DNA, 22 bp, Artificial Sequence
  Synthetic Construct
cccagctgccttctctcaactt

SEQ ID NO: 27597 - DNA, 23 bp, Artificial Sequence
  Synthetic Construct
gggtgcacatattccaggtcaac

SEQ ID NO: 27598 - DNA, 24 bp, Artificial Sequence
  Synthetic Construct
caggtaggaggtgttctggtcaag

SEQ ID NO: 27599 - DNA, 22 bp, Artificial Sequence
  Synthetic Construct
gggcctgacctgagacctaata

SEQ ID NO: 27600 - DNA, 20 bp, Artificial Sequence
  Synthetic Construct
cctggtgcagtggtatgcaa

SEQ ID NO: 27601 - DNA, 27 bp, Artificial Sequence
  Synthetic Construct
gactctaaccacttatcacctccattg

SEQ ID NO: 27602 - DNA, 23 bp, Artificial Sequence
  Synthetic Construct
gggaggatggaattcagccttgt

SEQ ID NO: 27603 - DNA, 21 bp, Artificial Sequence
  Synthetic Construct
ggttggagcagggaaatcagt

SEQ ID NO: 27604 - DNA, 19 bp, Artificial Sequence
  Synthetic Construct
accccaagccaccctccat

SEQ ID NO: 27605 - DNA, 20 bp, Artificial Sequence
  Synthetic Construct
actggagcagccttgagaca

SEQ ID NO: 27606 - DNA, 19 bp, Artificial Sequence
  Synthetic Construct
tcacaggcccagagtgtca

SEQ ID NO: 27607 - DNA, 21 bp, Artificial Sequence
  Synthetic Construct
ccacaaggccgcatctcatgt

SEQ ID NO: 27608 - DNA, 20 bp, Artificial Sequence
  Synthetic Construct
gctgcacctgttgacccatt

SEQ ID NO: 27609 - DNA, 20 bp, Artificial Sequence
  Synthetic Construct
acaccccaggacacaccaat

SEQ ID NO: 27610 - DNA, 20 bp, Artificial Sequence
  Synthetic Construct
gtgggctttgatgggactca

SEQ ID NO: 27611 - DNA, 21 bp, Artificial Sequence
  Synthetic Construct
gcgacaacggcccctcattta

SEQ ID NO: 27612 - DNA, 25 bp, Artificial Sequence
  Synthetic Construct
cttgagtccctgcacctttaattct

SEQ ID NO: 27613 - DNA, 23 bp, Artificial Sequence
  Synthetic Construct
gcccatgaacaaagtagccatga

SEQ ID NO: 27614 - DNA, 20 bp, Artificial Sequence
  Synthetic Construct
gattgcatggcacccagtct

SEQ ID NO: 27615 - DNA, 22 bp, Artificial Sequence
  Synthetic Construct
gagggaagggaagagagcctta

SEQ ID NO: 27616 - DNA, 22 bp, Artificial Sequence
  Synthetic Construct
ccttgacatcccaggctcaagt

SEQ ID NO: 27617 - DNA, 24 bp, Artificial Sequence
  Synthetic Construct
cgaagccgaaaaatggaagctatg

SEQ ID NO: 27618 - DNA, 20 bp, Artificial Sequence
  Synthetic Construct
cctggccaagaggccaacaa

SEQ ID NO: 27619 - DNA, 22 bp, Artificial Sequence
  Synthetic Construct
aggcccacagagaaggtgacat

SEQ ID NO: 27620 - DNA, 22 bp, Artificial Sequence
  Synthetic Construct
ccagaagtcctgctctgcttca

SEQ ID NO: 27621 - DNA, 25 bp, Artificial Sequence
  Synthetic Construct
ggctgggagtcaaaattagggtatc

SEQ ID NO: 27622 - DNA, 23 bp, Artificial Sequence
  Synthetic Construct
ggactgaagtcctcagaagcaaa

SEQ ID NO: 27623 - DNA, 22 bp, Artificial Sequence
  Synthetic Construct
gccctgggatccagaattccta

SEQ ID NO: 27624 - DNA, 22 bp, Artificial Sequence
  Synthetic Construct
caggagtccaccccactttaca

SEQ ID NO: 27625 - DNA, 21 bp, Artificial Sequence
  Synthetic Construct
cagggctggtccacaaaggaa

SEQ ID NO: 27626 - DNA, 22 bp, Artificial Sequence
  Synthetic Construct
ggacaaccagcacccaaaggaa

SEQ ID NO: 27627 - DNA, 22 bp, Artificial Sequence
  Synthetic Construct
gacaatgacgtggctccaccat

SEQ ID NO: 27628 - DNA, 20 bp, Artificial Sequence
  Synthetic Construct
accaggccaggcactaggaa

SEQ ID NO: 27629 - DNA, 21 bp, Artificial Sequence
  Synthetic Construct
agcaggggagcccattgatgt

SEQ ID NO: 27630 - DNA, 20 bp, Artificial Sequence
  Synthetic Construct
ccccgacctcccaagctact

SEQ ID NO: 27631 - DNA, 24 bp, Artificial Sequence
  Synthetic Construct
ggagaagttacttagccacactga

SEQ ID NO: 27632 - DNA, 22 bp, Artificial Sequence
  Synthetic Construct
acatgcgtggtgtctctaacat

SEQ ID NO: 27633 - DNA, 22 bp, Artificial Sequence
  Synthetic Construct
gcagctgttgcactgttttgtt

SEQ ID NO: 27634 - DNA, 21 bp, Artificial Sequence
  Synthetic Construct
cctcgaggaagcctcccctta

SEQ ID NO: 27635 - DNA, 25 bp, Artificial Sequence
  Synthetic Construct
gctttatttcctgcacatccaggtt

SEQ ID NO: 27636 - DNA, 22 bp, Artificial Sequence
  Synthetic Construct
gcttagaagctccacagcttga

SEQ ID NO: 27637 - DNA, 22 bp, Artificial Sequence
  Synthetic Construct
agtagggactgtggaggacaca

SEQ ID NO: 27638 - DNA, 26 bp, Artificial Sequence
  Synthetic Construct
cactgtgcaagaacagatggttcaga

SEQ ID NO: 27639 - DNA, 22 bp, Artificial Sequence
  Synthetic Construct
gccaaggttccaagagagagaa

SEQ ID NO: 27640 - DNA, 22 bp, Artificial Sequence
  Synthetic Construct
gaaacacggtctcactctgtca

SEQ ID NO: 27641 - DNA, 21 bp, Artificial Sequence
  Synthetic Construct
gcggttgcagctgtactctga

SEQ ID NO: 27642 - DNA, 20 bp, Artificial Sequence
  Synthetic Construct
tcgcccctccattgtcttct

SEQ ID NO: 27643 - DNA, 20 bp, Artificial Sequence
  Synthetic Construct
ggaggggcagtgacattcaa

SEQ ID NO: 27644 - DNA, 21 bp, Artificial Sequence
  Synthetic Construct
gcccaaagagagggtgctagt

SEQ ID NO: 27645 - DNA, 21 bp, Artificial Sequence
  Synthetic Construct
tgatttgtggggccagagaga

SEQ ID NO: 27646 - DNA, 20 bp, Artificial Sequence
  Synthetic Construct
tggccttggttggacacact

SEQ ID NO: 27647 - DNA, 25 bp, Artificial Sequence
  Synthetic Construct
gtgtagggtgttagttgtccacagt

SEQ ID NO: 27648 - DNA, 20 bp, Artificial Sequence
  Synthetic Construct
cccagcaactgtagcactga

SEQ ID NO: 27649 - DNA, 20 bp, Artificial Sequence
  Synthetic Construct
tgagccagggaatgcctgaa

SEQ ID NO: 27650 - DNA, 20 bp, Artificial Sequence
  Synthetic Construct
agggcatggtgacacacaac

SEQ ID NO: 27651 - DNA, 26 bp, Artificial Sequence
  Synthetic Construct
gaaggtcatctttcagggattacaga

SEQ ID NO: 27652 - DNA, 19 bp, Artificial Sequence
  Synthetic Construct
ccagcctgtccgcctctaa

SEQ ID NO: 27653 - DNA, 22 bp, Artificial Sequence
  Synthetic Construct
gttgtggaggcgagagtctgaa

SEQ ID NO: 27654 - DNA, 25 bp, Artificial Sequence
  Synthetic Construct
gttggcaacagttattttccaccta

SEQ ID NO: 27655 - DNA, 26 bp, Artificial Sequence
  Synthetic Construct
tccctcaatcctagcatacaacaatc

SEQ ID NO: 27656 - DNA, 23 bp, Artificial Sequence
  Synthetic Construct
gcttcaccaagcgtttcccttgt

SEQ ID NO: 27657 - DNA, 20 bp, Artificial Sequence
  Synthetic Construct
agcgtctgcctcacctcttg

SEQ ID NO: 27658 - DNA, 23 bp, Artificial Sequence
  Synthetic Construct
ccgcagactcagcaaactattct

SEQ ID NO: 27659 - DNA, 23 bp, Artificial Sequence
  Synthetic Construct
acactctgcatagctcagaacaa

SEQ ID NO: 27660 - DNA, 24 bp, Artificial Sequence
  Synthetic Construct
ctggaagaaaacggctctgataac

SEQ ID NO: 27661 - DNA, 23 bp, Artificial Sequence
  Synthetic Construct
ccactagtagccgtgtgaaagat

SEQ ID NO: 27662 - DNA, 24 bp, Artificial Sequence
  Synthetic Construct
gcctcaacgtcccctatcaagact

SEQ ID NO: 27663 - DNA, 19 bp, Artificial Sequence
  Synthetic Construct
aacccgccaccgtttgtct

SEQ ID NO: 27664 - DNA, 21 bp, Artificial Sequence
  Synthetic Construct
agggcctgcagaacacacatc

SEQ ID NO: 27665 - DNA, 22 bp, Artificial Sequence
  Synthetic Construct
gtgggtgtctcaccattgaaga

SEQ ID NO: 27666 - DNA, 24 bp, Artificial Sequence
  Synthetic Construct
ccatcagatgagtgccttagttct

SEQ ID NO: 27667 - DNA, 21 bp, Artificial Sequence
  Synthetic Construct
gaaacagcaaggtgtgtgcat

SEQ ID NO: 27668 - DNA, 23 bp, Artificial Sequence
  Synthetic Construct
cccatagccagcatgtttagaga

SEQ ID NO: 27669 - DNA, 21 bp, Artificial Sequence
  Synthetic Construct
gcagccagcactttgtgtttc

SEQ ID NO: 27670 - DNA, 20 bp, Artificial Sequence
  Synthetic Construct
cccactccaagcaccaaaca

SEQ ID NO: 27671 - DNA, 20 bp, Artificial Sequence
  Synthetic Construct
tgcaggtggcctgaggtttc

SEQ ID NO: 27672 - DNA, 21 bp, Artificial Sequence
  Synthetic Construct
ttggccccaggggtgagcata

SEQ ID NO: 27673 - DNA, 23 bp, Artificial Sequence
  Synthetic Construct
gaaaatccacccacactccagaa

SEQ ID NO: 27674 - DNA, 26 bp, Artificial Sequence
  Synthetic Construct
cgaagctgctttcacacactgtgatt

SEQ ID NO: 27675 - DNA, 25 bp, Artificial Sequence
  Synthetic Construct
gtgcaacgagttactgccgataatg

SEQ ID NO: 27676 - DNA, 21 bp, Artificial Sequence
  Synthetic Construct
ccccaagggtctaaccacaga

SEQ ID NO: 27677 - DNA, 20 bp, Artificial Sequence
  Synthetic Construct
tgggagtgacgtgccacaaa

SEQ ID NO: 27678 - DNA, 23 bp, Artificial Sequence
  Synthetic Construct
gggagtgaagtgcagtcctgaaa

SEQ ID NO: 27679 - DNA, 25 bp, Artificial Sequence
  Synthetic Construct
ccatatcttctctcaggccctatct

SEQ ID NO: 27680 - DNA, 21 bp, Artificial Sequence
  Synthetic Construct
tgggtgccacgtgtgatggta

SEQ ID NO: 27681 - DNA, 24 bp, Artificial Sequence
  Synthetic Construct
agtggaagagctttgtgtggtaag

SEQ ID NO: 27682 - DNA, 22 bp, Artificial Sequence
  Synthetic Construct
gtggacagccaggaaacagtca

SEQ ID NO: 27683 - DNA, 22 bp, Artificial Sequence
  Synthetic Construct
ctgagaagccgtctgcatccta

SEQ ID NO: 27684 - DNA, 24 bp, Artificial Sequence
  Synthetic Construct
agaggaaaagtatctcgcccaaaa

SEQ ID NO: 27685 - DNA, 22 bp, Artificial Sequence
  Synthetic Construct
tgccccgcaggggaattaaaac

SEQ ID NO: 27686 - DNA, 20 bp, Artificial Sequence
  Synthetic Construct
agggccagggctccaaaatc

SEQ ID NO: 27687 - DNA, 19 bp, Artificial Sequence
  Synthetic Construct
accatgaaggcgccactgt

SEQ ID NO: 27688 - DNA, 18 bp, Artificial Sequence
  Synthetic Construct
ttgcccagtgcgtagcaa

SEQ ID NO: 27689 - DNA, 21 bp, Artificial Sequence
  Synthetic Construct
gaaaagcaggagaggctcact

SEQ ID NO: 27690 - DNA, 22 bp, Artificial Sequence
  Synthetic Construct
cactgcaccccgcttcgattta

SEQ ID NO: 27691 - DNA, 22 bp, Artificial Sequence
  Synthetic Construct
gtggggactgggctctcaaaat

SEQ ID NO: 27692 - DNA, 21 bp, Artificial Sequence
  Synthetic Construct
acctcattcctcctggacaca

SEQ ID NO: 27693 - DNA, 24 bp, Artificial Sequence
  Synthetic Construct
ctgacacacagagggaaaatccta

SEQ ID NO: 27694 - DNA, 22 bp, Artificial Sequence
  Synthetic Construct
gggatgcttagagcaggcagtt

SEQ ID NO: 27695 - DNA, 21 bp, Artificial Sequence
  Synthetic Construct
cttacgcacgtggcagaaatc

SEQ ID NO: 27696 - DNA, 22 bp, Artificial Sequence
  Synthetic Construct
gggcaggtgtgcactgtctaaa

SEQ ID NO: 27697 - DNA, 21 bp, Artificial Sequence
  Synthetic Construct
gggaggtgcagtgcaggaaat

SEQ ID NO: 27698 - DNA, 22 bp, Artificial Sequence
  Synthetic Construct
ctggactttgggttggcacatt

SEQ ID NO: 27699 - DNA, 22 bp, Artificial Sequence
  Synthetic Construct
ctctcctgctcctccaaagcat

SEQ ID NO: 27700 - DNA, 20 bp, Artificial Sequence
  Synthetic Construct
ttcccacccaccaaccagat

SEQ ID NO: 27701 - DNA, 22 bp, Artificial Sequence
  Synthetic Construct
ccaggaatgttccggccgttag

SEQ ID NO: 27702 - DNA, 22 bp, Artificial Sequence
  Synthetic Construct
atgggaaggcctgggaggtaat

SEQ ID NO: 27703 - DNA, 19 bp, Artificial Sequence
  Synthetic Construct
cgccgcaccaggacttgat

SEQ ID NO: 27704 - DNA, 24 bp, Artificial Sequence
  Synthetic Construct
ggtgaagagcagctgaagtgctta

SEQ ID NO: 27705 - DNA, 21 bp, Artificial Sequence
  Synthetic Construct
tggtgggacgtcagccttcta

SEQ ID NO: 27706 - DNA, 23 bp, Artificial Sequence
  Synthetic Construct
gcctgacaggagtttctgtggaa

SEQ ID NO: 27707 - DNA, 22 bp, Artificial Sequence
  Synthetic Construct
ggttgtccaggccagttcacta

SEQ ID NO: 27708 - DNA, 20 bp, Artificial Sequence
  Synthetic Construct
tgttgagggcagggctctaa

SEQ ID NO: 27709 - DNA, 21 bp, Artificial Sequence
  Synthetic Construct
tgaggtggaagccaggtctct

SEQ ID NO: 27710 - DNA, 20 bp, Artificial Sequence
  Synthetic Construct
acctggtcacctgtgtgctt

SEQ ID NO: 27711 - DNA, 21 bp, Artificial Sequence
  Synthetic Construct
agactcccagggacccaaact

SEQ ID NO: 27712 - DNA, 21 bp, Artificial Sequence
  Synthetic Construct
ggcagggctgtcacaatgact

SEQ ID NO: 27713 - DNA, 22 bp, Artificial Sequence
  Synthetic Construct
acacaacttagtgcaggccaaa

SEQ ID NO: 27714 - DNA, 20 bp, Artificial Sequence
  Synthetic Construct
ccaacacccaggcagctgaa

SEQ ID NO: 27715 - DNA, 20 bp, Artificial Sequence
  Synthetic Construct
gctgcctttgcccctgtctt

SEQ ID NO: 27716 - DNA, 20 bp, Artificial Sequence
  Synthetic Construct
tccaccctcgcctctccatt

SEQ ID NO: 27717 - DNA, 25 bp, Artificial Sequence
  Synthetic Construct
gagggctaccagtaagaaccagaga

SEQ ID NO: 27718 - DNA, 19 bp, Artificial Sequence
  Synthetic Construct
cctggggccagacaactga

SEQ ID NO: 27719 - DNA, 21 bp, Artificial Sequence
  Synthetic Construct
cccaaatgcactgagctgtca

SEQ ID NO: 27720 - DNA, 23 bp, Artificial Sequence
  Synthetic Construct
ttcttgggccagtgaagagaaaa

SEQ ID NO: 27721 - DNA, 25 bp, Artificial Sequence
  Synthetic Construct
accagaatcttcacagagtttgtct

SEQ ID NO: 27722 - DNA, 22 bp, Artificial Sequence
  Synthetic Construct
cagtgcaatgctttcaccatgt

SEQ ID NO: 27723 - DNA, 21 bp, Artificial Sequence
  Synthetic Construct
tttctgtgccagctggttttg

SEQ ID NO: 27724 - DNA, 22 bp, Artificial Sequence
  Synthetic Construct
cctccctgaagttgccttctca

SEQ ID NO: 27725 - DNA, 25 bp, Artificial Sequence
  Synthetic Construct
tgaagggattccattttctggcttt

SEQ ID NO: 27726 - DNA, 20 bp, Artificial Sequence
  Synthetic Construct
tcagtccctggccccgtgat

SEQ ID NO: 27727 - DNA, 23 bp, Artificial Sequence
  Synthetic Construct
gcagatctctctaggctttgtgt

SEQ ID NO: 27728 - DNA, 20 bp, Artificial Sequence
  Synthetic Construct
accactctagtgcccctgaa

SEQ ID NO: 27729 - DNA, 18 bp, Artificial Sequence
  Synthetic Construct
gaaggcgagcagcagtca

SEQ ID NO: 27730 - DNA, 20 bp, Artificial Sequence
  Synthetic Construct
acagagcgtccacccgtctt

SEQ ID NO: 27731 - DNA, 21 bp, Artificial Sequence
  Synthetic Construct
ccctgggaagtgacagctcaa

SEQ ID NO: 27732 - DNA, 22 bp, Artificial Sequence
  Synthetic Construct
agagggtgctcaggtgtttaga

SEQ ID NO: 27733 - DNA, 21 bp, Artificial Sequence
  Synthetic Construct
ctcggaactcctgccaagaag

SEQ ID NO: 27734 - DNA, 24 bp, Artificial Sequence
  Synthetic Construct
ctcaggttcaaaatcaggcaggtt

SEQ ID NO: 27735 - DNA, 20 bp, Artificial Sequence
  Synthetic Construct
gctgcctcactgtctgatgt

SEQ ID NO: 27736 - DNA, 20 bp, Artificial Sequence
  Synthetic Construct
ggccctgttcgaagcagttt

SEQ ID NO: 27737 - DNA, 21 bp, Artificial Sequence
  Synthetic Construct
gactgggagctctttgctcat

SEQ ID NO: 27738 - DNA, 19 bp, Artificial Sequence
  Synthetic Construct
agcagtgcggtcgggaaga

SEQ ID NO: 27739 - DNA, 22 bp, Artificial Sequence
  Synthetic Construct
ggaaatggcacactggttctca

SEQ ID NO: 27740 - DNA, 20 bp, Artificial Sequence
  Synthetic Construct
gctgagcgttggaagccatt

SEQ ID NO: 27741 - DNA, 22 bp, Artificial Sequence
  Synthetic Construct
cacccctgacatgtgtggtaca

SEQ ID NO: 27742 - DNA, 23 bp, Artificial Sequence
  Synthetic Construct
ggacaagtagcgatccactgaca

SEQ ID NO: 27743 - DNA, 22 bp, Artificial Sequence
  Synthetic Construct
ttccacctggctcctatctctt

SEQ ID NO: 27744 - DNA, 22 bp, Artificial Sequence
  Synthetic Construct
catgtatcttgcgcagggtttc

SEQ ID NO: 27745 - DNA, 20 bp, Artificial Sequence
  Synthetic Construct
tggggtcctgggagccaaat

SEQ ID NO: 27746 - DNA, 22 bp, Artificial Sequence
  Synthetic Construct
ccggagtggaagggcaacaata

SEQ ID NO: 27747 - DNA, 23 bp, Artificial Sequence
  Synthetic Construct
ctgatgccaaggccgtatatcat

SEQ ID NO: 27748 - DNA, 20 bp, Artificial Sequence
  Synthetic Construct
cagatgcctgctgcttctgt

SEQ ID NO: 27749 - DNA, 23 bp, Artificial Sequence
  Synthetic Construct
gagacagggtttgcaggaaggaa

SEQ ID NO: 27750 - DNA, 24 bp, Artificial Sequence
  Synthetic Construct
ggctggggtcactgtactttcctt

SEQ ID NO: 27751 - DNA, 23 bp, Artificial Sequence
  Synthetic Construct
cttcttccccacagaccacattg

SEQ ID NO: 27752 - DNA, 21 bp, Artificial Sequence
  Synthetic Construct
agctggggaaccaggatgaac

SEQ ID NO: 27753 - DNA, 21 bp, Artificial Sequence
  Synthetic Construct
ggttgtgacaagacgcacaca

SEQ ID NO: 27754 - DNA, 23 bp, Artificial Sequence
  Synthetic Construct
cacttcttagggcttccggtttc

SEQ ID NO: 27755 - DNA, 18 bp, Artificial Sequence
  Synthetic Construct
ccggggcccttcaaacat

SEQ ID NO: 27756 - DNA, 22 bp, Artificial Sequence
  Synthetic Construct
cacccacccttgccaaccataa

SEQ ID NO: 27757 - DNA, 26 bp, Artificial Sequence
  Synthetic Construct
ccaaaatgatggcaagcagctaccta

SEQ ID NO: 27758 - DNA, 20 bp, Artificial Sequence
  Synthetic Construct
gtgctcaccagccacattct

SEQ ID NO: 27759 - DNA, 20 bp, Artificial Sequence
  Synthetic Construct
caacaagtgccaccctcaga

SEQ ID NO: 27760 - DNA, 22 bp, Artificial Sequence
  Synthetic Construct
gcaatggtcatggatggagctt

SEQ ID NO: 27761 - DNA, 20 bp, Artificial Sequence
  Synthetic Construct
gtgcggggcctctgaacata

SEQ ID NO: 27762 - DNA, 22 bp, Artificial Sequence
  Synthetic Construct
gctccaagaccagccataccta

SEQ ID NO: 27763 - DNA, 22 bp, Artificial Sequence
  Synthetic Construct
ctttgctgctaggttgggatca

SEQ ID NO: 27764 - DNA, 19 bp, Artificial Sequence
  Synthetic Construct
agggacagctgcccaggtt

SEQ ID NO: 27765 - DNA, 22 bp, Artificial Sequence
  Synthetic Construct
gcgtgcacagctgagaatcctt

SEQ ID NO: 27766 - DNA, 21 bp, Artificial Sequence
  Synthetic Construct
tcggtccgatggtcccttaga

SEQ ID NO: 27767 - DNA, 23 bp, Artificial Sequence
  Synthetic Construct
cccaggtctgagccacttactct

SEQ ID NO: 27768 - DNA, 22 bp, Artificial Sequence
  Synthetic Construct
gccccatgcctataacctgcta

SEQ ID NO: 27769 - DNA, 23 bp, Artificial Sequence
  Synthetic Construct
ctatgaaggcagggacttctgtt

SEQ ID NO: 27770 - DNA, 23 bp, Artificial Sequence
  Synthetic Construct
gtggtggagggaagagaaacttg

SEQ ID NO: 27771 - DNA, 21 bp, Artificial Sequence
  Synthetic Construct
tcccttggccaactcccttct

SEQ ID NO: 27772 - DNA, 23 bp, Artificial Sequence
  Synthetic Construct
cccctctctgaccatccatatct

SEQ ID NO: 27773 - DNA, 22 bp, Artificial Sequence
  Synthetic Construct
ccttgggctgagtgtggttaag

SEQ ID NO: 27774 - DNA, 22 bp, Artificial Sequence
  Synthetic Construct
aaagattggctgaggcttctgt

SEQ ID NO: 27775 - DNA, 20 bp, Artificial Sequence
  Synthetic Construct
acgttttcctccgtgccaaa

SEQ ID NO: 27776 - DNA, 22 bp, Artificial Sequence
  Synthetic Construct
cagagcacatgacccaaagact

SEQ ID NO: 27777 - DNA, 23 bp, Artificial Sequence
  Synthetic Construct
tcatcatggtgggtctctgagta

SEQ ID NO: 27778 - DNA, 23 bp, Artificial Sequence
  Synthetic Construct
caaatacagccccaggttactgt

SEQ ID NO: 27779 - DNA, 26 bp, Artificial Sequence
  Synthetic Construct
gcacaaaggttcatggacaggaaaga

SEQ ID NO: 27780 - DNA, 23 bp, Artificial Sequence
  Synthetic Construct
ccagccaggcagtcatagacaga

SEQ ID NO: 27781 - DNA, 22 bp, Artificial Sequence
  Synthetic Construct
taggggacggggacagttgtag

SEQ ID NO: 27782 - DNA, 23 bp, Artificial Sequence
  Synthetic Construct
gcatgctcacgtcaaactcgata

SEQ ID NO: 27783 - DNA, 24 bp, Artificial Sequence
  Synthetic Construct
tgaggccaaagaggaaatgattct

SEQ ID NO: 27784 - DNA, 22 bp, Artificial Sequence
  Synthetic Construct
gctgctccatcttgtccagaac

SEQ ID NO: 27785 - DNA, 23 bp, Artificial Sequence
  Synthetic Construct
tggatgcacacatgcaagaaaga

SEQ ID NO: 27786 - DNA, 21 bp, Artificial Sequence
  Synthetic Construct
ggcagaggacaggctaaaact

SEQ ID NO: 27787 - DNA, 21 bp, Artificial Sequence
  Synthetic Construct
ccccaaccagggatgttgctt

SEQ ID NO: 27788 - DNA, 23 bp, Artificial Sequence
  Synthetic Construct
aggagttcttcccactctgttgt

SEQ ID NO: 27789 - DNA, 24 bp, Artificial Sequence
  Synthetic Construct
agctgtgtccctccataaagaaag

SEQ ID NO: 27790 - DNA, 20 bp, Artificial Sequence
  Synthetic Construct
aggcaccagtgcaagtcaag

SEQ ID NO: 27791 - DNA, 25 bp, Artificial Sequence
  Synthetic Construct
ctctcaattgctctcgaacttgttg

SEQ ID NO: 27792 - DNA, 22 bp, Artificial Sequence
  Synthetic Construct
cctccttgcggtggagaaatga

SEQ ID NO: 27793 - DNA, 22 bp, Artificial Sequence
  Synthetic Construct
ccctggaccctgctgattgttt

SEQ ID NO: 27794 - DNA, 22 bp, Artificial Sequence
  Synthetic Construct
ggcccagacattgaaggcatag

SEQ ID NO: 27795 - DNA, 22 bp, Artificial Sequence
  Synthetic Construct
aggcctgcatctgatggtatct

SEQ ID NO: 27796 - DNA, 21 bp, Artificial Sequence
  Synthetic Construct
aggagggctgtgtccttgaga

SEQ ID NO: 27797 - DNA, 25 bp, Artificial Sequence
  Synthetic Construct
gccaagaattagaccttgcatcctt

SEQ ID NO: 27798 - DNA, 20 bp, Artificial Sequence
  Synthetic Construct
gcctcctgcctttccctctt

SEQ ID NO: 27799 - DNA, 24 bp, Artificial Sequence
  Synthetic Construct
ccagcagccgaatgagattggata

SEQ ID NO: 27800 - DNA, 22 bp, Artificial Sequence
  Synthetic Construct
tcagtaccgagaggcgatggaa

SEQ ID NO: 27801 - DNA, 21 bp, Artificial Sequence
  Synthetic Construct
atctctggcctaggtggttca

SEQ ID NO: 27802 - DNA, 26 bp, Artificial Sequence
  Synthetic Construct
ctctggcagaagtgtgaagaagtaat

SEQ ID NO: 27803 - DNA, 20 bp, Artificial Sequence
  Synthetic Construct
ttgggccctctggctctaaa

SEQ ID NO: 27804 - DNA, 22 bp, Artificial Sequence
  Synthetic Construct
cgcacatgttggtgacaacttt

SEQ ID NO: 27805 - DNA, 22 bp, Artificial Sequence
  Synthetic Construct
gggagtagctggaatgggtgat

SEQ ID NO: 27806 - DNA, 19 bp, Artificial Sequence
  Synthetic Construct
ttgccctcaggccttctca

SEQ ID NO: 27807 - DNA, 23 bp, Artificial Sequence
  Synthetic Construct
ccaaccggagagcaaaagggaaa

SEQ ID NO: 27808 - DNA, 21 bp, Artificial Sequence
  Synthetic Construct
cgtgacggtgtgggtttccaa

SEQ ID NO: 27809 - DNA, 20 bp, Artificial Sequence
  Synthetic Construct
tcccgggcttccagaacaac

SEQ ID NO: 27810 - DNA, 23 bp, Artificial Sequence
  Synthetic Construct
ctcagcagagaggaggccttaga

SEQ ID NO: 27811 - DNA, 22 bp, Artificial Sequence
  Synthetic Construct
caggcctgtggtgggtttttgt

SEQ ID NO: 27812 - DNA, 22 bp, Artificial Sequence
  Synthetic Construct
ccatggctcccattctgcatgt

SEQ ID NO: 27813 - DNA, 20 bp, Artificial Sequence
  Synthetic Construct
aggcaggcgtagggcagtta

SEQ ID NO: 27814 - DNA, 20 bp, Artificial Sequence
  Synthetic Construct
ctcccctctcacccatgctt

SEQ ID NO: 27815 - DNA, 20 bp, Artificial Sequence
  Synthetic Construct
acccagttcagagcctcctt

SEQ ID NO: 27816 - DNA, 25 bp, Artificial Sequence
  Synthetic Construct
tttctatagactttcgccagtggaa

SEQ ID NO: 27817 - DNA, 21 bp, Artificial Sequence
  Synthetic Construct
gcagatgggtgtggagagcaa

SEQ ID NO: 27818 - DNA, 24 bp, Artificial Sequence
  Synthetic Construct
gactcatgcctgtatcctcagcta

SEQ ID NO: 27819 - DNA, 20 bp, Artificial Sequence
  Synthetic Construct
caacttgtgggtgcgggtat

SEQ ID NO: 27820 - DNA, 21 bp, Artificial Sequence
  Synthetic Construct
gaaggctggaaccatcgaagt

SEQ ID NO: 27821 - DNA, 21 bp, Artificial Sequence
  Synthetic Construct
cttgttccaacgggtcagcat

SEQ ID NO: 27822 - DNA, 21 bp, Artificial Sequence
  Synthetic Construct
tgggtgctggagaccttgtca

SEQ ID NO: 27823 - DNA, 19 bp, Artificial Sequence
  Synthetic Construct
ggctcctgggaagcacctt

SEQ ID NO: 27824 - DNA, 22 bp, Artificial Sequence
  Synthetic Construct
gcttcaggccagcttcagtagt

SEQ ID NO: 27825 - DNA, 20 bp, Artificial Sequence
  Synthetic Construct
ccaggttccaggcacgactt

SEQ ID NO: 27826 - DNA, 20 bp, Artificial Sequence
  Synthetic Construct
accagcagccagaggagtca

SEQ ID NO: 27827 - DNA, 21 bp, Artificial Sequence
  Synthetic Construct
ggctctcccaccccagtttac

SEQ ID NO: 27828 - DNA, 21 bp, Artificial Sequence
  Synthetic Construct
tcactggctgagggagagaca

SEQ ID NO: 27829 - DNA, 24 bp, Artificial Sequence
  Synthetic Construct
aagaatccctgaggcagtaacatc

SEQ ID NO: 27830 - DNA, 22 bp, Artificial Sequence
  Synthetic Construct
ccttctgcctatgtgcagttct

SEQ ID NO: 27831 - DNA, 21 bp, Artificial Sequence
  Synthetic Construct
ccacccagctctccttcactt

SEQ ID NO: 27832 - DNA, 20 bp, Artificial Sequence
  Synthetic Construct
gccagccactgtgccactat

SEQ ID NO: 27833 - DNA, 20 bp, Artificial Sequence
  Synthetic Construct
gcacccaagccacaagacaa

SEQ ID NO: 27834 - DNA, 21 bp, Artificial Sequence
  Synthetic Construct
tggcacaggcatctggtgtag

SEQ ID NO: 27835 - DNA, 20 bp, Artificial Sequence
  Synthetic Construct
tcctctgggtgccaaacagt

SEQ ID NO: 27836 - DNA, 22 bp, Artificial Sequence
  Synthetic Construct
gccctcggggaagaaatcaaga

SEQ ID NO: 27837 - DNA, 23 bp, Artificial Sequence
  Synthetic Construct
cggggtgacattattgcctaagt

SEQ ID NO: 27838 - DNA, 21 bp, Artificial Sequence
  Synthetic Construct
gcatgctggctgctgacatag

SEQ ID NO: 27839 - DNA, 22 bp, Artificial Sequence
  Synthetic Construct
gtgcacaggcctcctggattta

SEQ ID NO: 27840 - DNA, 19 bp, Artificial Sequence
  Synthetic Construct
cggcaggcaggatgggaat

SEQ ID NO: 27841 - DNA, 21 bp, Artificial Sequence
  Synthetic Construct
ttggcaggtggctgccattga

SEQ ID NO: 27842 - DNA, 20 bp, Artificial Sequence
  Synthetic Construct
agccatcatgcccagtgcaa

SEQ ID NO: 27843 - DNA, 27 bp, Artificial Sequence
  Synthetic Construct
gtctcaagagactcatatgccctggat

SEQ ID NO: 27844 - DNA, 22 bp, Artificial Sequence
  Synthetic Construct
ggcctgaattcacacaggcatt

SEQ ID NO: 27845 - DNA, 20 bp, Artificial Sequence
  Synthetic Construct
cagtggcccaccaacctcat

SEQ ID NO: 27846 - DNA, 23 bp, Artificial Sequence
  Synthetic Construct
ccaaaaggcatggggtagggatt

SEQ ID NO: 27847 - DNA, 22 bp, Artificial Sequence
  Synthetic Construct
tcccctggctgctctgagaaat

SEQ ID NO: 27848 - DNA, 20 bp, Artificial Sequence
  Synthetic Construct
atgcgcttggtcccttcctt

SEQ ID NO: 27849 - DNA, 19 bp, Artificial Sequence
  Synthetic Construct
tgggccatccacagctttc

SEQ ID NO: 27850 - DNA, 21 bp, Artificial Sequence
  Synthetic Construct
ggccggaaggagaccagacta

SEQ ID NO: 27851 - DNA, 20 bp, Artificial Sequence
  Synthetic Construct
ttttgccccagctggactct

SEQ ID NO: 27852 - DNA, 22 bp, Artificial Sequence
  Synthetic Construct
tggctggcatcagccagatttc

SEQ ID NO: 27853 - DNA, 23 bp, Artificial Sequence
  Synthetic Construct
cctgtcctgacaccatccagtaa

SEQ ID NO: 27854 - DNA, 24 bp, Artificial Sequence
  Synthetic Construct
catcagagcagagaagcagttgat

SEQ ID NO: 27855 - DNA, 24 bp, Artificial Sequence
  Synthetic Construct
cacagtgttgatggcattgtctct

SEQ ID NO: 27856 - DNA, 21 bp, Artificial Sequence
  Synthetic Construct
gcccatgcctcttctgcttgt

SEQ ID NO: 27857 - DNA, 21 bp, Artificial Sequence
  Synthetic Construct
tgagccagcccagagttcagt

SEQ ID NO: 27858 - DNA, 20 bp, Artificial Sequence
  Synthetic Construct
tttggcgccaggagtagctt

SEQ ID NO: 27859 - DNA, 19 bp, Artificial Sequence
  Synthetic Construct
tgccctgctcagcctcatt

SEQ ID NO: 27860 - DNA, 20 bp, Artificial Sequence
  Synthetic Construct
gcaacagacaccagcacatc

SEQ ID NO: 27861 - DNA, 26 bp, Artificial Sequence
  Synthetic Construct
ggactaaaagagagatccaggctaac

SEQ ID NO: 27862 - DNA, 21 bp, Artificial Sequence
  Synthetic Construct
gcccaggcacctccactcata

SEQ ID NO: 27863 - DNA, 20 bp, Artificial Sequence
  Synthetic Construct
tgccgtcagccctggaaaaa

SEQ ID NO: 27864 - DNA, 19 bp, Artificial Sequence
  Synthetic Construct
gctggccggaactcagctt

SEQ ID NO: 27865 - DNA, 21 bp, Artificial Sequence
  Synthetic Construct
gaggagggccagagcaatatc

SEQ ID NO: 27866 - DNA, 24 bp, Artificial Sequence
  Synthetic Construct
aggcaaacaacctcaccatttagt

SEQ ID NO: 27867 - DNA, 20 bp, Artificial Sequence
  Synthetic Construct
gctttgggaggtgtggcata

SEQ ID NO: 27868 - DNA, 20 bp, Artificial Sequence
  Synthetic Construct
tgggtaggcccacagcatct

SEQ ID NO: 27869 - DNA, 22 bp, Artificial Sequence
  Synthetic Construct
gccaggaaagggacatcaaagt

SEQ ID NO: 27870 - DNA, 20 bp, Artificial Sequence
  Synthetic Construct
cagaagcggcatgccttgat

SEQ ID NO: 27871 - DNA, 19 bp, Artificial Sequence
  Synthetic Construct
agcacccagccctcacact

SEQ ID NO: 27872 - DNA, 23 bp, Artificial Sequence
  Synthetic Construct
catgtgctacccatggtgttact

SEQ ID NO: 27873 - DNA, 23 bp, Artificial Sequence
  Synthetic Construct
ggctgcctataaccaagcaatca

SEQ ID NO: 27874 - DNA, 22 bp, Artificial Sequence
  Synthetic Construct
ctggccggcaccactcttttat

SEQ ID NO: 27875 - DNA, 21 bp, Artificial Sequence
  Synthetic Construct
ggggtccagctgaacttctga

SEQ ID NO: 27876 - DNA, 21 bp, Artificial Sequence
  Synthetic Construct
gtgaaacctgctggagggatt

SEQ ID NO: 27877 - DNA, 24 bp, Artificial Sequence
  Synthetic Construct
gctttgtccctggctcaaaacctt

SEQ ID NO: 27878 - DNA, 23 bp, Artificial Sequence
  Synthetic Construct
ccatatatcccagccaggctctt

SEQ ID NO: 27879 - DNA, 23 bp, Artificial Sequence
  Synthetic Construct
cctgtgtccttttgcaaatcagt

SEQ ID NO: 27880 - DNA, 20 bp, Artificial Sequence
  Synthetic Construct
ggggcctccaaaaacacaac

SEQ ID NO: 27881 - DNA, 28 bp, Artificial Sequence
  Synthetic Construct
cctcaggatgacagtgaatacaactgaa

SEQ ID NO: 27882 - DNA, 21 bp, Artificial Sequence
  Synthetic Construct
tcctcttgctgcagtgtgatt

SEQ ID NO: 27883 - DNA, 22 bp, Artificial Sequence
  Synthetic Construct
cttctaagcccaccccaacact

SEQ ID NO: 27884 - DNA, 24 bp, Artificial Sequence
  Synthetic Construct
ctgtgttagcagggatcaggtcta

SEQ ID NO: 27885 - DNA, 19 bp, Artificial Sequence
  Synthetic Construct
agcgctggcaggcaggaat

SEQ ID NO: 27886 - DNA, 24 bp, Artificial Sequence
  Synthetic Construct
actgaaaatagctcaggtgcaaca

SEQ ID NO: 27887 - DNA, 25 bp, Artificial Sequence
  Synthetic Construct
cagtaggactcttaggcctgtggtt

SEQ ID NO: 27888 - DNA, 22 bp, Artificial Sequence
  Synthetic Construct
ggaggaggctggtgttcataag

SEQ ID NO: 27889 - DNA, 20 bp, Artificial Sequence
  Synthetic Construct
gtggccacagcagtgatgat

SEQ ID NO: 27890 - DNA, 21 bp, Artificial Sequence
  Synthetic Construct
tcttgccctcctcatggctaa

SEQ ID NO: 27891 - DNA, 23 bp, Artificial Sequence
  Synthetic Construct
gtcccctcactgttcctggaatg

SEQ ID NO: 27892 - DNA, 23 bp, Artificial Sequence
  Synthetic Construct
gtcccagtggcatgagaaagttg

SEQ ID NO: 27893 - DNA, 22 bp, Artificial Sequence
  Synthetic Construct
agggcagaccaggagaagtgtt

SEQ ID NO: 27894 - DNA, 23 bp, Artificial Sequence
  Synthetic Construct
tgtggtattgagactggcctgat

SEQ ID NO: 27895 - DNA, 20 bp, Artificial Sequence
  Synthetic Construct
aagaggcaccactcctcctt

SEQ ID NO: 27896 - DNA, 22 bp, Artificial Sequence
  Synthetic Construct
tgggatggcagcctgagttgta

SEQ ID NO: 27897 - DNA, 21 bp, Artificial Sequence
  Synthetic Construct
acccctcccctcctgaaatct

SEQ ID NO: 27898 - DNA, 19 bp, Artificial Sequence
  Synthetic Construct
cacctgatccggccagctt

SEQ ID NO: 27899 - DNA, 20 bp, Artificial Sequence
  Synthetic Construct
ttctgcaccctaccctgtct

SEQ ID NO: 27900 - DNA, 22 bp, Artificial Sequence
  Synthetic Construct
ctcccaccccacacacatttca

SEQ ID NO: 27901 - DNA, 20 bp, Artificial Sequence
  Synthetic Construct
agcgggaagctcctactcaa

SEQ ID NO: 27902 - DNA, 25 bp, Artificial Sequence
  Synthetic Construct
gaggcagtttaacaagcacttgact

SEQ ID NO: 27903 - DNA, 20 bp, Artificial Sequence
  Synthetic Construct
cctccccgcatcctttctca

SEQ ID NO: 27904 - DNA, 22 bp, Artificial Sequence
  Synthetic Construct
aggacaaccagaggtcactctt

SEQ ID NO: 27905 - DNA, 23 bp, Artificial Sequence
  Synthetic Construct
cactccctgccagcaaaacattg

SEQ ID NO: 27906 - DNA, 19 bp, Artificial Sequence
  Synthetic Construct
tgcgggcactcggaaacat

SEQ ID NO: 27907 - DNA, 24 bp, Artificial Sequence
  Synthetic Construct
ggatgaacagcagtctcagtggtt

SEQ ID NO: 27908 - DNA, 19 bp, Artificial Sequence
  Synthetic Construct
gaggctgctctcccagtca

SEQ ID NO: 27909 - DNA, 20 bp, Artificial Sequence
  Synthetic Construct
atgggagcccgggttgtaag

SEQ ID NO: 27910 - DNA, 21 bp, Artificial Sequence
  Synthetic Construct
gccaggccacacaacatgata

SEQ ID NO: 27911 - DNA, 21 bp, Artificial Sequence
  Synthetic Construct
cgcaacagagcagtcacatct

SEQ ID NO: 27912 - DNA, 21 bp, Artificial Sequence
  Synthetic Construct
gcctttggacgcgaggagtaa

SEQ ID NO: 27913 - DNA, 21 bp, Artificial Sequence
  Synthetic Construct
tcttgctctcacaaggccaaa

SEQ ID NO: 27914 - DNA, 22 bp, Artificial Sequence
  Synthetic Construct
cacacatgcaccagctcaaaca

SEQ ID NO: 27915 - DNA, 20 bp, Artificial Sequence
  Synthetic Construct
agccaacagcctacccaaac

SEQ ID NO: 27916 - DNA, 22 bp, Artificial Sequence
  Synthetic Construct
acacacctgtggtccaagtatc

SEQ ID NO: 27917 - DNA, 22 bp, Artificial Sequence
  Synthetic Construct
gtgccattccctttcccagttt

SEQ ID NO: 27918 - DNA, 20 bp, Artificial Sequence
  Synthetic Construct
aggccatcagcctgggaaga

SEQ ID NO: 27919 - DNA, 27 bp, Artificial Sequence
  Synthetic Construct
gtctatgaatgcctcacaaccagatag

SEQ ID NO: 27920 - DNA, 22 bp, Artificial Sequence
  Synthetic Construct
ttgtggaaagccctgaaagtct

SEQ ID NO: 27921 - DNA, 20 bp, Artificial Sequence
  Synthetic Construct
actgcagcgcctgtaagttg

SEQ ID NO: 27922 - DNA, 22 bp, Artificial Sequence
  Synthetic Construct
cggagggactcctcacactaac

SEQ ID NO: 27923 - DNA, 23 bp, Artificial Sequence
  Synthetic Construct
agatgccgttattggtggaagaa

SEQ ID NO: 27924 - DNA, 22 bp, Artificial Sequence
  Synthetic Construct
atgggccaggcactctgctatc

SEQ ID NO: 27925 - DNA, 21 bp, Artificial Sequence
  Synthetic Construct
gcactggacgactgctggttt

SEQ ID NO: 27926 - DNA, 21 bp, Artificial Sequence
  Synthetic Construct
ggctcctggcttttggcttct

SEQ ID NO: 27927 - DNA, 21 bp, Artificial Sequence
  Synthetic Construct
ggctcaagggcaagcatgttc

SEQ ID NO: 27928 - DNA, 20 bp, Artificial Sequence
  Synthetic Construct
cagagggcacgggtgtttgt

SEQ ID NO: 27929 - DNA, 24 bp, Artificial Sequence
  Synthetic Construct
gagccaattagcagtgagagaaca

SEQ ID NO: 27930 - DNA, 23 bp, Artificial Sequence
  Synthetic Construct
cccatccacaggtcactgaggta

SEQ ID NO: 27931 - DNA, 22 bp, Artificial Sequence
  Synthetic Construct
ggagggccactgtttaccgaat

SEQ ID NO: 27932 - DNA, 22 bp, Artificial Sequence
  Synthetic Construct
acactgcctagcacatgaaaga

SEQ ID NO: 27933 - DNA, 21 bp, Artificial Sequence
  Synthetic Construct
ctggtcaggcaaggagaaagt

SEQ ID NO: 27934 - DNA, 24 bp, Artificial Sequence
  Synthetic Construct
gccaagtggaaacaggatatgaga

SEQ ID NO: 27935 - DNA, 21 bp, Artificial Sequence
  Synthetic Construct
ccctgcagctcacacagcaat

SEQ ID NO: 27936 - DNA, 22 bp, Artificial Sequence
  Synthetic Construct
ggcatacacccacaccatccaa

SEQ ID NO: 27937 - DNA, 24 bp, Artificial Sequence
  Synthetic Construct
cccataccaactccatctcctatg

SEQ ID NO: 27938 - DNA, 19 bp, Artificial Sequence
  Synthetic Construct
gcgaacacccgtccttcat

SEQ ID NO: 27939 - DNA, 19 bp, Artificial Sequence
  Synthetic Construct
cctgcccggttggatgtca

SEQ ID NO: 27940 - DNA, 22 bp, Artificial Sequence
  Synthetic Construct
gatctggggacgaggtcctaaa

SEQ ID NO: 27941 - DNA, 19 bp, Artificial Sequence
  Synthetic Construct
tcccatggccgggattcat

SEQ ID NO: 27942 - DNA, 18 bp, Artificial Sequence
  Synthetic Construct
cgcgcacacatgcacaca

SEQ ID NO: 27943 - DNA, 23 bp, Artificial Sequence
  Synthetic Construct
gacctgacttgccatctggagaa

SEQ ID NO: 27944 - DNA, 24 bp, Artificial Sequence
  Synthetic Construct
ctcagcctcctacttctgcttttg

SEQ ID NO: 27945 - DNA, 20 bp, Artificial Sequence
  Synthetic Construct
gctgggcttaagaggctgaa

SEQ ID NO: 27946 - DNA, 22 bp, Artificial Sequence
  Synthetic Construct
cagaggcaggtcatctggtgta

SEQ ID NO: 27947 - DNA, 25 bp, Artificial Sequence
  Synthetic Construct
gggcaaaatgtgtagacggcactac

SEQ ID NO: 27948 - DNA, 20 bp, Artificial Sequence
  Synthetic Construct
tgtgggaccagggtttctct

SEQ ID NO: 27949 - DNA, 23 bp, Artificial Sequence
  Synthetic Construct
gcagcacctcgcatgtaacaaac

SEQ ID NO: 27950 - DNA, 24 bp, Artificial Sequence
  Synthetic Construct
gtcataagccattgtctgctctgt

SEQ ID NO: 27951 - DNA, 23 bp, Artificial Sequence
  Synthetic Construct
gctactcctctgggatgtagagt

SEQ ID NO: 27952 - DNA, 26 bp, Artificial Sequence
  Synthetic Construct
catctcctcaaggctatctgttttga

SEQ ID NO: 27953 - DNA, 22 bp, Artificial Sequence
  Synthetic Construct
tccctccacctggcactcattt

SEQ ID NO: 27954 - DNA, 26 bp, Artificial Sequence
  Synthetic Construct
cagttggtctacggccttttaatttc

SEQ ID NO: 27955 - DNA, 21 bp, Artificial Sequence
  Synthetic Construct
tctcagagcctccctttgcat

SEQ ID NO: 27956 - DNA, 20 bp, Artificial Sequence
  Synthetic Construct
gccaccttgtgagcgtgaaa

SEQ ID NO: 27957 - DNA, 20 bp, Artificial Sequence
  Synthetic Construct
gagtcctttgagccgtgtgt

SEQ ID NO: 27958 - DNA, 22 bp, Artificial Sequence
  Synthetic Construct
tggtacctgagggcactaccat

SEQ ID NO: 27959 - DNA, 25 bp, Artificial Sequence
  Synthetic Construct
ccaacaggacgtgcaaataaagtca

SEQ ID NO: 27960 - DNA, 20 bp, Artificial Sequence
  Synthetic Construct
gcccaaaggccgctcaattt

SEQ ID NO: 27961 - DNA, 21 bp, Artificial Sequence
  Synthetic Construct
tgggtctagcctccctactgt

SEQ ID NO: 27962 - DNA, 25 bp, Artificial Sequence
  Synthetic Construct
gtacctgaaaagttccagcaaaact

SEQ ID NO: 27963 - DNA, 24 bp, Artificial Sequence
  Synthetic Construct
gcagctagagaagctatccggttt

SEQ ID NO: 27964 - DNA, 22 bp, Artificial Sequence
  Synthetic Construct
cgctgggaccttgcgtaaagaa

SEQ ID NO: 27965 - DNA, 20 bp, Artificial Sequence
  Synthetic Construct
cccaggcctgttgagagcta

SEQ ID NO: 27966 - DNA, 22 bp, Artificial Sequence
  Synthetic Construct
ctgctggcatctccagcttcat

SEQ ID NO: 27967 - DNA, 26 bp, Artificial Sequence
  Synthetic Construct
cacctaaaagcactcacacagctaca

SEQ ID NO: 27968 - DNA, 20 bp, Artificial Sequence
  Synthetic Construct
gttgtcggcgcctagtggaa

SEQ ID NO: 27969 - DNA, 21 bp, Artificial Sequence
  Synthetic Construct
caaatctgcgggaggggtatg

SEQ ID NO: 27970 - DNA, 24 bp, Artificial Sequence
  Synthetic Construct
ctcaatttgctaacgtcactgtgt

SEQ ID NO: 27971 - DNA, 20 bp, Artificial Sequence
  Synthetic Construct
gccaccacactggccaataa

SEQ ID NO: 27972 - DNA, 22 bp, Artificial Sequence
  Synthetic Construct
gggaaacacgtctgcagctcaa

SEQ ID NO: 27973 - DNA, 22 bp, Artificial Sequence
  Synthetic Construct
cccttcctccaacccctcttca

SEQ ID NO: 27974 - DNA, 19 bp, Artificial Sequence
  Synthetic Construct
acagggagcaaccctgtgt

SEQ ID NO: 27975 - DNA, 20 bp, Artificial Sequence
  Synthetic Construct
gggctgtccctctggtctga

SEQ ID NO: 27976 - DNA, 23 bp, Artificial Sequence
  Synthetic Construct
ggatgtgtgctgtagtgatgtgt

SEQ ID NO: 27977 - DNA, 23 bp, Artificial Sequence
  Synthetic Construct
ggaatggacccatcacagacact

SEQ ID NO: 27978 - DNA, 21 bp, Artificial Sequence
  Synthetic Construct
gccaggtgcagtatgggaaag

SEQ ID NO: 27979 - DNA, 23 bp, Artificial Sequence
  Synthetic Construct
acctgctgcagaattttgtgaga

SEQ ID NO: 27980 - DNA, 23 bp, Artificial Sequence
  Synthetic Construct
caaggagacctggactctgcttt

SEQ ID NO: 27981 - DNA, 22 bp, Artificial Sequence
  Synthetic Construct
tgctgttttcctgtagcaccat

SEQ ID NO: 27982 - DNA, 25 bp, Artificial Sequence
  Synthetic Construct
ctctgatgtgcttgggaattcattt

SEQ ID NO: 27983 - DNA, 23 bp, Artificial Sequence
  Synthetic Construct
agatggaatggcaggtgaaatct

SEQ ID NO: 27984 - DNA, 26 bp, Artificial Sequence
  Synthetic Construct
cttgtgcccagttttagagaacaaag

SEQ ID NO: 27985 - DNA, 22 bp, Artificial Sequence
  Synthetic Construct
gcatgcccaggttttggtcttg

SEQ ID NO: 27986 - DNA, 20 bp, Artificial Sequence
  Synthetic Construct
atgaccctccccgaccaaga

SEQ ID NO: 27987 - DNA, 19 bp, Artificial Sequence
  Synthetic Construct
aggctggagggctcacctt

SEQ ID NO: 27988 - DNA, 19 bp, Artificial Sequence
  Synthetic Construct
tgctgcccagaagcactga

SEQ ID NO: 27989 - DNA, 21 bp, Artificial Sequence
  Synthetic Construct
gtcagggacccaggttgaaaa

SEQ ID NO: 27990 - DNA, 20 bp, Artificial Sequence
  Synthetic Construct
taccctgcctggcccaaata

SEQ ID NO: 27991 - DNA, 22 bp, Artificial Sequence
  Synthetic Construct
ggttgccagtctgattgtggta

SEQ ID NO: 27992 - DNA, 22 bp, Artificial Sequence
  Synthetic Construct
caagcaccctggaggagatgaa

SEQ ID NO: 27993 - DNA, 22 bp, Artificial Sequence
  Synthetic Construct
gtccacctcaccacaactctga

SEQ ID NO: 27994 - DNA, 26 bp, Artificial Sequence
  Synthetic Construct
ctcatcctagagcttgagcactcatc

SEQ ID NO: 27995 - DNA, 24 bp, Artificial Sequence
  Synthetic Construct
gcaacagggcctttataagggaat

SEQ ID NO: 27996 - DNA, 23 bp, Artificial Sequence
  Synthetic Construct
cagagtaatgcatgcagggaaga

SEQ ID NO: 27997 - DNA, 21 bp, Artificial Sequence
  Synthetic Construct
cccagtcacaggtggggagtt

SEQ ID NO: 27998 - DNA, 25 bp, Artificial Sequence
  Synthetic Construct
cataggtagtgccatttgagctgat

SEQ ID NO: 27999 - DNA, 24 bp, Artificial Sequence
  Synthetic Construct
cctgaaatcccatcgtgtggctta

SEQ ID NO: 28000 - DNA, 25 bp, Artificial Sequence
  Synthetic Construct
ggtcccatgtggagtctgttacttc

SEQ ID NO: 28001 - DNA, 22 bp, Artificial Sequence
  Synthetic Construct
cacttggcctggcttgatgtga

SEQ ID NO: 28002 - DNA, 20 bp, Artificial Sequence
  Synthetic Construct
gactgggcacagtgttggta

SEQ ID NO: 28003 - DNA, 22 bp, Artificial Sequence
  Synthetic Construct
tgtagagggcctttctctcact

SEQ ID NO: 28004 - DNA, 22 bp, Artificial Sequence
  Synthetic Construct
cagttctgggcggaaacagtga

SEQ ID NO: 28005 - DNA, 21 bp, Artificial Sequence
  Synthetic Construct
aaaacgcgccatttcaaggaa

SEQ ID NO: 28006 - DNA, 20 bp, Artificial Sequence
  Synthetic Construct
ggagcccagtgagcttcatc

SEQ ID NO: 28007 - DNA, 19 bp, Artificial Sequence
  Synthetic Construct
caggaggcttgccctgtgt

SEQ ID NO: 28008 - DNA, 23 bp, Artificial Sequence
  Synthetic Construct
ccttttctcctctgcctgtggta

SEQ ID NO: 28009 - DNA, 27 bp, Artificial Sequence
  Synthetic Construct
gaccttgtttgtctgtatctgagctat

SEQ ID NO: 28010 - DNA, 25 bp, Artificial Sequence
  Synthetic Construct
gcacagcatgttaaacgctaatttc

SEQ ID NO: 28011 - DNA, 23 bp, Artificial Sequence
  Synthetic Construct
ctcaggcagattgacaggtgtgt

SEQ ID NO: 28012 - DNA, 23 bp, Artificial Sequence
  Synthetic Construct
gcccattcccaccattggatttg

SEQ ID NO: 28013 - DNA, 20 bp, Artificial Sequence
  Synthetic Construct
tgaggtgtggggcaacttgt

SEQ ID NO: 28014 - DNA, 24 bp, Artificial Sequence
  Synthetic Construct
caaccccaagtcagactcatcaac

SEQ ID NO: 28015 - DNA, 24 bp, Artificial Sequence
  Synthetic Construct
ccagggaggatggcttctgaattg

SEQ ID NO: 28016 - DNA, 24 bp, Artificial Sequence
  Synthetic Construct
ggtacaggtgtgcaaagcagtgat

SEQ ID NO: 28017 - DNA, 20 bp, Artificial Sequence
  Synthetic Construct
ggggcacagcaccagtttca

SEQ ID NO: 28018 - DNA, 21 bp, Artificial Sequence
  Synthetic Construct
ccaggctggtgacagacaaac

SEQ ID NO: 28019 - DNA, 22 bp, Artificial Sequence
  Synthetic Construct
tgccttgttcaccctccacttg

SEQ ID NO: 28020 - DNA, 20 bp, Artificial Sequence
  Synthetic Construct
ccgtctggcaggaccgtatc

SEQ ID NO: 28021 - DNA, 21 bp, Artificial Sequence
  Synthetic Construct
gggagaggcagaattcggaaa

SEQ ID NO: 28022 - DNA, 20 bp, Artificial Sequence
  Synthetic Construct
tgctgttccagccggacctt

SEQ ID NO: 28023 - DNA, 20 bp, Artificial Sequence
  Synthetic Construct
gagcacaaggaggccgtttt

SEQ ID NO: 28024 - DNA, 19 bp, Artificial Sequence
  Synthetic Construct
tggtcccggctccatcaga

SEQ ID NO: 28025 - DNA, 21 bp, Artificial Sequence
  Synthetic Construct
accctgatggtttgcaccttt

SEQ ID NO: 28026 - DNA, 20 bp, Artificial Sequence
  Synthetic Construct
gtctggctgccctggtcaaa

SEQ ID NO: 28027 - DNA, 23 bp, Artificial Sequence
  Synthetic Construct
caccggcccacttactctcttac

SEQ ID NO: 28028 - DNA, 23 bp, Artificial Sequence
  Synthetic Construct
ctgggtcctggaattctgatgtt

SEQ ID NO: 28029 - DNA, 24 bp, Artificial Sequence
  Synthetic Construct
acctgtgggactacctgaggtcta

SEQ ID NO: 28030 - DNA, 19 bp, Artificial Sequence
  Synthetic Construct
gcggcaggtgaatgagtgt

SEQ ID NO: 28031 - DNA, 25 bp, Artificial Sequence
  Synthetic Construct
ggcctcataaattagaaccctggat

SEQ ID NO: 28032 - DNA, 20 bp, Artificial Sequence
  Synthetic Construct
cagagggcagagcgctgaat

SEQ ID NO: 28033 - DNA, 21 bp, Artificial Sequence
  Synthetic Construct
agtcatcctccccaccaccat

SEQ ID NO: 28034 - DNA, 24 bp, Artificial Sequence
  Synthetic Construct
cctgagccatcctggaagctttac

SEQ ID NO: 28035 - DNA, 23 bp, Artificial Sequence
  Synthetic Construct
gcacgggctagaactctcacttc

SEQ ID NO: 28036 - DNA, 22 bp, Artificial Sequence
  Synthetic Construct
gagcaggaagcctgagtcttga

SEQ ID NO: 28037 - DNA, 23 bp, Artificial Sequence
  Synthetic Construct
ctcctctgttcccttttgtggat

SEQ ID NO: 28038 - DNA, 23 bp, Artificial Sequence
  Synthetic Construct
aggacaatgccctagaagcaaat

SEQ ID NO: 28039 - DNA, 22 bp, Artificial Sequence
  Synthetic Construct
gcagggtctggtttgcatttga

SEQ ID NO: 28040 - DNA, 23 bp, Artificial Sequence
  Synthetic Construct
tgcctccactccaacttctttag

SEQ ID NO: 28041 - DNA, 22 bp, Artificial Sequence
  Synthetic Construct
ctcctgcagtgtcaccttgttg

SEQ ID NO: 28042 - DNA, 23 bp, Artificial Sequence
  Synthetic Construct
ggccaatgcacgtactattgctt

SEQ ID NO: 28043 - DNA, 20 bp, Artificial Sequence
  Synthetic Construct
aacctgcacacctgccaatc

SEQ ID NO: 28044 - DNA, 22 bp, Artificial Sequence
  Synthetic Construct
tggagcgaagtcatgtcagtct

SEQ ID NO: 28045 - DNA, 22 bp, Artificial Sequence
  Synthetic Construct
ggaggggctactagaagcaaac

SEQ ID NO: 28046 - DNA, 24 bp, Artificial Sequence
  Synthetic Construct
tgcctggcaatgttagataaggat

SEQ ID NO: 28047 - DNA, 19 bp, Artificial Sequence
  Synthetic Construct
ccgccctctctcaccatgt

SEQ ID NO: 28048 - DNA, 21 bp, Artificial Sequence
  Synthetic Construct
tggcatcgccatccaccctaa

SEQ ID NO: 28049 - DNA, 21 bp, Artificial Sequence
  Synthetic Construct
cccctgtgtttgtcgggtgat

SEQ ID NO: 28050 - DNA, 21 bp, Artificial Sequence
  Synthetic Construct
ggttgccaaactgtcccaact

SEQ ID NO: 28051 - DNA, 25 bp, Artificial Sequence
  Synthetic Construct
ggcacagattctggttagaatggaa

SEQ ID NO: 28052 - DNA, 21 bp, Artificial Sequence
  Synthetic Construct
catttccgctcacaagccatt

SEQ ID NO: 28053 - DNA, 20 bp, Artificial Sequence
  Synthetic Construct
gactcagcccggaattcgtt

SEQ ID NO: 28054 - DNA, 22 bp, Artificial Sequence
  Synthetic Construct
ccaaggtatggcaggagtttgt

SEQ ID NO: 28055 - DNA, 20 bp, Artificial Sequence
  Synthetic Construct
tgcagtgctgctccatgtgt

SEQ ID NO: 28056 - DNA, 21 bp, Artificial Sequence
  Synthetic Construct
atcctagggccccgtaagtca

SEQ ID NO: 28057 - DNA, 25 bp, Artificial Sequence
  Synthetic Construct
cgtggcttggaagagatacatttca

SEQ ID NO: 28058 - DNA, 21 bp, Artificial Sequence
  Synthetic Construct
tcaaaccccaccaaccctaca

SEQ ID NO: 28059 - DNA, 19 bp, Artificial Sequence
  Synthetic Construct
cccagggttggggttcctt

SEQ ID NO: 28060 - DNA, 22 bp, Artificial Sequence
  Synthetic Construct
cccatcttttctccaggcactt

SEQ ID NO: 28061 - DNA, 20 bp, Artificial Sequence
  Synthetic Construct
ctgccagccttgaactctgt

SEQ ID NO: 28062 - DNA, 21 bp, Artificial Sequence
  Synthetic Construct
cccacagcatcgatgacaaac

SEQ ID NO: 28063 - DNA, 19 bp, Artificial Sequence
  Synthetic Construct
accaggcagctccatgttg

SEQ ID NO: 28064 - DNA, 25 bp, Artificial Sequence
  Synthetic Construct
caggacccaatagaagtcgggaata

SEQ ID NO: 28065 - DNA, 22 bp, Artificial Sequence
  Synthetic Construct
ggtgcacccaagcataaggttt

SEQ ID NO: 28066 - DNA, 23 bp, Artificial Sequence
  Synthetic Construct
agatgtgggaggaaaggatgttc

SEQ ID NO: 28067 - DNA, 22 bp, Artificial Sequence
  Synthetic Construct
ggtgcctctggagttgtgaagt

SEQ ID NO: 28068 - DNA, 24 bp, Artificial Sequence
  Synthetic Construct
gccaagtttcccagagaatgaatc

SEQ ID NO: 28069 - DNA, 20 bp, Artificial Sequence
  Synthetic Construct
gccagataagggccgagttc

SEQ ID NO: 28070 - DNA, 24 bp, Artificial Sequence
  Synthetic Construct
aggacaaaatgcattcaggacact

SEQ ID NO: 28071 - DNA, 23 bp, Artificial Sequence
  Synthetic Construct
ccagtttgttagcctcaaagcaa

SEQ ID NO: 28072 - DNA, 20 bp, Artificial Sequence
  Synthetic Construct
tcggcttgacctacctgctt

SEQ ID NO: 28073 - DNA, 21 bp, Artificial Sequence
  Synthetic Construct
aacctgtcaccctgggactca

SEQ ID NO: 28074 - DNA, 23 bp, Artificial Sequence
  Synthetic Construct
ggtttgaccaggcatgtcactca

SEQ ID NO: 28075 - DNA, 19 bp, Artificial Sequence
  Synthetic Construct
tgactggctgcacgctcaa

SEQ ID NO: 28076 - DNA, 19 bp, Artificial Sequence
  Synthetic Construct
atggcctccgtgcctcatc

SEQ ID NO: 28077 - DNA, 24 bp, Artificial Sequence
  Synthetic Construct
cccaggaaactctagaggaggatt

SEQ ID NO: 28078 - DNA, 20 bp, Artificial Sequence
  Synthetic Construct
tcatgcagggccactctttg

SEQ ID NO: 28079 - DNA, 26 bp, Artificial Sequence
  Synthetic Construct
ctctttggcaactagagacacaactt

SEQ ID NO: 28080 - DNA, 24 bp, Artificial Sequence
  Synthetic Construct
ggaatattggctcaggtccaagaa

SEQ ID NO: 28081 - DNA, 21 bp, Artificial Sequence
  Synthetic Construct
cccggccttgaagtggtcttt

SEQ ID NO: 28082 - DNA, 21 bp, Artificial Sequence
  Synthetic Construct
aggatggaccccactgacact

SEQ ID NO: 28083 - DNA, 22 bp, Artificial Sequence
  Synthetic Construct
gagggcccctaatgtctctctt

SEQ ID NO: 28084 - DNA, 27 bp, Artificial Sequence
  Synthetic Construct
gctgtatctcaatcttttccaggaagt

SEQ ID NO: 28085 - DNA, 22 bp, Artificial Sequence
  Synthetic Construct
gcctcctcccagacaaatccaa

SEQ ID NO: 28086 - DNA, 22 bp, Artificial Sequence
  Synthetic Construct
gtgcctggatgaaccctgtttg

SEQ ID NO: 28087 - DNA, 20 bp, Artificial Sequence
  Synthetic Construct
tgagctgctgttgggactga

SEQ ID NO: 28088 - DNA, 20 bp, Artificial Sequence
  Synthetic Construct
actgcgcatgctcgaaatct

SEQ ID NO: 28089 - DNA, 22 bp, Artificial Sequence
  Synthetic Construct
cctcacctcatgcacacccttt

SEQ ID NO: 28090 - DNA, 22 bp, Artificial Sequence
  Synthetic Construct
cctggggatgagtagcaaccaa

SEQ ID NO: 28091 - DNA, 20 bp, Artificial Sequence
  Synthetic Construct
attgaccccacggtgtcttc

SEQ ID NO: 28092 - DNA, 23 bp, Artificial Sequence
  Synthetic Construct
gtggaggtctacgtcctcagttg

SEQ ID NO: 28093 - DNA, 23 bp, Artificial Sequence
  Synthetic Construct
ctgtgcaaaatccttccgtcttg

SEQ ID NO: 28094 - DNA, 25 bp, Artificial Sequence
  Synthetic Construct
gccagaataccgaggtcttggttag

SEQ ID NO: 28095 - DNA, 23 bp, Artificial Sequence
  Synthetic Construct
ccatagtacgtgaaggccccatt

SEQ ID NO: 28096 - DNA, 23 bp, Artificial Sequence
  Synthetic Construct
aggagaaaatggtgcttgtggaa

SEQ ID NO: 28097 - DNA, 20 bp, Artificial Sequence
  Synthetic Construct
caccagccccaaagcacaaa

SEQ ID NO: 28098 - DNA, 22 bp, Artificial Sequence
  Synthetic Construct
agcaggaggaaagcaggtcttg

SEQ ID NO: 28099 - DNA, 23 bp, Artificial Sequence
  Synthetic Construct
tgattggcaacactgtaggtgat

SEQ ID NO: 28100 - DNA, 22 bp, Artificial Sequence
  Synthetic Construct
agtctgagcatcccttgtctga

SEQ ID NO: 28101 - DNA, 19 bp, Artificial Sequence
  Synthetic Construct
tgcaagtccagtgctgctt

SEQ ID NO: 28102 - DNA, 22 bp, Artificial Sequence
  Synthetic Construct
tcctccccagtccccacatttt

SEQ ID NO: 28103 - DNA, 23 bp, Artificial Sequence
  Synthetic Construct
gtgggagaggcaggtacttcaga

SEQ ID NO: 28104 - DNA, 22 bp, Artificial Sequence
  Synthetic Construct
gctcccaagccactggtaaagt

SEQ ID NO: 28105 - DNA, 22 bp, Artificial Sequence
  Synthetic Construct
ggcttggagaaagggctgagaa

SEQ ID NO: 28106 - DNA, 20 bp, Artificial Sequence
  Synthetic Construct
accagccccagagagacatt

SEQ ID NO: 28107 - DNA, 22 bp, Artificial Sequence
  Synthetic Construct
gcacctggaaaagggagtgtga

SEQ ID NO: 28108 - DNA, 22 bp, Artificial Sequence
  Synthetic Construct
acagggtccccatggtcatcaa

SEQ ID NO: 28109 - DNA, 21 bp, Artificial Sequence
  Synthetic Construct
ccagtgcccctgcacagtatt

SEQ ID NO: 28110 - DNA, 21 bp, Artificial Sequence
  Synthetic Construct
cagcacggtgtgactgaaatg

SEQ ID NO: 28111 - DNA, 23 bp, Artificial Sequence
  Synthetic Construct
ggtccagaacccttcaacaccta

SEQ ID NO: 28112 - DNA, 20 bp, Artificial Sequence
  Synthetic Construct
ctttggcagggaggcagaaa

SEQ ID NO: 28113 - DNA, 20 bp, Artificial Sequence
  Synthetic Construct
agggtgagttggggactgaa

SEQ ID NO: 28114 - DNA, 20 bp, Artificial Sequence
  Synthetic Construct
cacgctgcaggcacaaaact

SEQ ID NO: 28115 - DNA, 25 bp, Artificial Sequence
  Synthetic Construct
aggggaaaggtgaaagctaagtaag

SEQ ID NO: 28116 - DNA, 24 bp, Artificial Sequence
  Synthetic Construct
gcacttaagagctgagccttgtga

SEQ ID NO: 28117 - DNA, 21 bp, Artificial Sequence
  Synthetic Construct
ggagcagctacgttcatgtct

SEQ ID NO: 28118 - DNA, 23 bp, Artificial Sequence
  Synthetic Construct
tccacatgcctcaaaaagacaca

SEQ ID NO: 28119 - DNA, 24 bp, Artificial Sequence
  Synthetic Construct
ggatgtgtttgtgagccgaacaag

SEQ ID NO: 28120 - DNA, 20 bp, Artificial Sequence
  Synthetic Construct
acccctcggaggacgtgtca

SEQ ID NO: 28121 - DNA, 21 bp, Artificial Sequence
  Synthetic Construct
cccaacactgtcacccatcat

SEQ ID NO: 28122 - DNA, 21 bp, Artificial Sequence
  Synthetic Construct
gaggacaagggaatgcacgta

SEQ ID NO: 28123 - DNA, 22 bp, Artificial Sequence
  Synthetic Construct
tgacagacccactgaggtgact

SEQ ID NO: 28124 - DNA, 23 bp, Artificial Sequence
  Synthetic Construct
gcttggcagtaggacagaccaaa

SEQ ID NO: 28125 - DNA, 21 bp, Artificial Sequence
  Synthetic Construct
aactggcctcactctggaaag

SEQ ID NO: 28126 - DNA, 25 bp, Artificial Sequence
  Synthetic Construct
gttccctttctcctctacctagcat

SEQ ID NO: 28127 - DNA, 22 bp, Artificial Sequence
  Synthetic Construct
gctgagctcaagccctctatct

SEQ ID NO: 28128 - DNA, 20 bp, Artificial Sequence
  Synthetic Construct
aggaaggggatgagcaggaa

SEQ ID NO: 28129 - DNA, 22 bp, Artificial Sequence
  Synthetic Construct
tgaggacttcccctaccactct

SEQ ID NO: 28130 - DNA, 21 bp, Artificial Sequence
  Synthetic Construct
tcaggtccaccagtgtgaaac

SEQ ID NO: 28131 - DNA, 21 bp, Artificial Sequence
  Synthetic Construct
gggatgtcgaggtgctaggtt

SEQ ID NO: 28132 - DNA, 24 bp, Artificial Sequence
  Synthetic Construct
gggaccatccctgactcttacatt

SEQ ID NO: 28133 - DNA, 20 bp, Artificial Sequence
  Synthetic Construct
acccggccatctttggtaca

SEQ ID NO: 28134 - DNA, 23 bp, Artificial Sequence
  Synthetic Construct
gctatagagccgtctgcatccaa

SEQ ID NO: 28135 - DNA, 22 bp, Artificial Sequence
  Synthetic Construct
ccatggtgccagaaggtcttga

SEQ ID NO: 28136 - DNA, 22 bp, Artificial Sequence
  Synthetic Construct
ggctggacacgttcaagcttac

SEQ ID NO: 28137 - DNA, 24 bp, Artificial Sequence
  Synthetic Construct
aggtagatggcaaaatctgtggaa

SEQ ID NO: 28138 - DNA, 23 bp, Artificial Sequence
  Synthetic Construct
gatggagcctgaggcattaaaca

SEQ ID NO: 28139 - DNA, 20 bp, Artificial Sequence
  Synthetic Construct
ggccatgggacagcatttct

SEQ ID NO: 28140 - DNA, 22 bp, Artificial Sequence
  Synthetic Construct
cagagcagaaccccatgctttg

SEQ ID NO: 28141 - DNA, 23 bp, Artificial Sequence
  Synthetic Construct
gaagtccttgctgctggagaaga

SEQ ID NO: 28142 - DNA, 25 bp, Artificial Sequence
  Synthetic Construct
acaatctagggaaggcaatttgtca

SEQ ID NO: 28143 - DNA, 23 bp, Artificial Sequence
  Synthetic Construct
ccactgtctcccttccttgaatg

SEQ ID NO: 28144 - DNA, 22 bp, Artificial Sequence
  Synthetic Construct
gaacttggctgggaaccaggat

SEQ ID NO: 28145 - DNA, 22 bp, Artificial Sequence
  Synthetic Construct
atggagccccactaccgaagta

SEQ ID NO: 28146 - DNA, 21 bp, Artificial Sequence
  Synthetic Construct
caaccaaagtggcaacgaact

SEQ ID NO: 28147 - DNA, 21 bp, Artificial Sequence
  Synthetic Construct
gggcatggtggaaaagcttga

SEQ ID NO: 28148 - DNA, 21 bp, Artificial Sequence
  Synthetic Construct
gcatgggagccaacagtcagt

SEQ ID NO: 28149 - DNA, 21 bp, Artificial Sequence
  Synthetic Construct
gccaccgcacctggactattt

SEQ ID NO: 28150 - DNA, 24 bp, Artificial Sequence
  Synthetic Construct
ctttattgggcaccatctcacatc

SEQ ID NO: 28151 - DNA, 25 bp, Artificial Sequence
  Synthetic Construct
cgttccctctctctccaacttttag

SEQ ID NO: 28152 - DNA, 18 bp, Artificial Sequence
  Synthetic Construct
tgtcgcgatgccgaagaa

SEQ ID NO: 28153 - DNA, 23 bp, Artificial Sequence
  Synthetic Construct
gccccattgcctaccttttcaga

SEQ ID NO: 28154 - DNA, 20 bp, Artificial Sequence
  Synthetic Construct
tggctccaggtccagcatca

SEQ ID NO: 28155 - DNA, 20 bp, Artificial Sequence
  Synthetic Construct
tccagcaggtgcctgacaca

SEQ ID NO: 28156 - DNA, 22 bp, Artificial Sequence
  Synthetic Construct
acctccacatcctgctgtcaga

SEQ ID NO: 28157 - DNA, 21 bp, Artificial Sequence
  Synthetic Construct
gtgtgggccaaaggttgtaga

SEQ ID NO: 28158 - DNA, 25 bp, Artificial Sequence
  Synthetic Construct
ccaagaaaatcacgtttgggaaaga

SEQ ID NO: 28159 - DNA, 19 bp, Artificial Sequence
  Synthetic Construct
ccaccagccatccgtgtgt

SEQ ID NO: 28160 - DNA, 20 bp, Artificial Sequence
  Synthetic Construct
gtctgcagggcagaaagtga

SEQ ID NO: 28161 - DNA, 20 bp, Artificial Sequence
  Synthetic Construct
gtggtgtgcagtgagtggat

SEQ ID NO: 28162 - DNA, 18 bp, Artificial Sequence
  Synthetic Construct
gcacccacagcaccacat

SEQ ID NO: 28163 - DNA, 22 bp, Artificial Sequence
  Synthetic Construct
gcaccaactagctgacctgtga

SEQ ID NO: 28164 - DNA, 22 bp, Artificial Sequence
  Synthetic Construct
gggagggtggaaggaaaagaca

SEQ ID NO: 28165 - DNA, 23 bp, Artificial Sequence
  Synthetic Construct
gggcaccagtaatccaaactcaa

SEQ ID NO: 28166 - DNA, 21 bp, Artificial Sequence
  Synthetic Construct
ccacccagtcctgaagccatt

SEQ ID NO: 28167 - DNA, 22 bp, Artificial Sequence
  Synthetic Construct
actcggctcctatcgagtgcaa

SEQ ID NO: 28168 - DNA, 21 bp, Artificial Sequence
  Synthetic Construct
gggagcactgccatcctttgt

SEQ ID NO: 28169 - DNA, 22 bp, Artificial Sequence
  Synthetic Construct
caggcttgtggagaggatgtca

SEQ ID NO: 28170 - DNA, 22 bp, Artificial Sequence
  Synthetic Construct
atgccaggccagtcctgtacta

SEQ ID NO: 28171 - DNA, 23 bp, Artificial Sequence
  Synthetic Construct
cccaatggaaaccctagaacaca

SEQ ID NO: 28172 - DNA, 21 bp, Artificial Sequence
  Synthetic Construct
gctgggtcaacagctctttca

SEQ ID NO: 28173 - DNA, 20 bp, Artificial Sequence
  Synthetic Construct
ggcctccaggaagaaagcaa

SEQ ID NO: 28174 - DNA, 20 bp, Artificial Sequence
  Synthetic Construct
tgtccccaggctgtctctca

SEQ ID NO: 28175 - DNA, 24 bp, Artificial Sequence
  Synthetic Construct
ggcatcctacaaacttcccttgta

SEQ ID NO: 28176 - DNA, 19 bp, Artificial Sequence
  Synthetic Construct
acacccagccagtgtctca

SEQ ID NO: 28177 - DNA, 20 bp, Artificial Sequence
  Synthetic Construct
gcccgggtccaggttacttc

SEQ ID NO: 28178 - DNA, 22 bp, Artificial Sequence
  Synthetic Construct
gggcatggctgtgttccagtaa

SEQ ID NO: 28179 - DNA, 22 bp, Artificial Sequence
  Synthetic Construct
gaagaccaccaggaccatgatt

SEQ ID NO: 28180 - DNA, 20 bp, Artificial Sequence
  Synthetic Construct
tctcccggcttccaaccaaa

SEQ ID NO: 28181 - DNA, 21 bp, Artificial Sequence
  Synthetic Construct
gccacctcctcttccccttag

SEQ ID NO: 28182 - DNA, 21 bp, Artificial Sequence
  Synthetic Construct
ggaagcgagcttggaacttct

SEQ ID NO: 28183 - DNA, 24 bp, Artificial Sequence
  Synthetic Construct
ctgtggctgtcccagcagataaag

SEQ ID NO: 28184 - DNA, 20 bp, Artificial Sequence
  Synthetic Construct
ggctggaatgcagtggtaca

SEQ ID NO: 28185 - DNA, 22 bp, Artificial Sequence
  Synthetic Construct
gacagcaaggcaagctgagaac

SEQ ID NO: 28186 - DNA, 26 bp, Artificial Sequence
  Synthetic Construct
gtaatcccagcagatcacactttctt

SEQ ID NO: 28187 - DNA, 22 bp, Artificial Sequence
  Synthetic Construct
gtcagatggcctctgcacctta

SEQ ID NO: 28188 - DNA, 25 bp, Artificial Sequence
  Synthetic Construct
agttctctcaaacattggccctatt

SEQ ID NO: 28189 - DNA, 23 bp, Artificial Sequence
  Synthetic Construct
agagacctgctctcaaggcatta

SEQ ID NO: 28190 - DNA, 20 bp, Artificial Sequence
  Synthetic Construct
tgccttggctgacctacaac

SEQ ID NO: 28191 - DNA, 21 bp, Artificial Sequence
  Synthetic Construct
agaggctggcagagacctact

SEQ ID NO: 28192 - DNA, 19 bp, Artificial Sequence
  Synthetic Construct
gcccgaccttcaagccaaa

SEQ ID NO: 28193 - DNA, 20 bp, Artificial Sequence
  Synthetic Construct
tggcacacaccccaaagcta

SEQ ID NO: 28194 - DNA, 20 bp, Artificial Sequence
  Synthetic Construct
gaagtccagtgcccctccaa

SEQ ID NO: 28195 - DNA, 22 bp, Artificial Sequence
  Synthetic Construct
ccctgcaggtaggagggactat

SEQ ID NO: 28196 - DNA, 22 bp, Artificial Sequence
  Synthetic Construct
tgtgaagatggcttgtcccttt

SEQ ID NO: 28197 - DNA, 19 bp, Artificial Sequence
  Synthetic Construct
agctccaacctcgctgagt

SEQ ID NO: 28198 - DNA, 22 bp, Artificial Sequence
  Synthetic Construct
tgctggtgaccctgagtcaatg

SEQ ID NO: 28199 - DNA, 20 bp, Artificial Sequence
  Synthetic Construct
tttcgggccttcccgctaaa

SEQ ID NO: 28200 - DNA, 22 bp, Artificial Sequence
  Synthetic Construct
caaaggctgcagacagatgaag

SEQ ID NO: 28201 - DNA, 20 bp, Artificial Sequence
  Synthetic Construct
ggcacagaggctacacacat

SEQ ID NO: 28202 - DNA, 24 bp, Artificial Sequence
  Synthetic Construct
ccccaggtgaatactgtgccttca

SEQ ID NO: 28203 - DNA, 22 bp, Artificial Sequence
  Synthetic Construct
ggaggaaatcccagcactggtt

SEQ ID NO: 28204 - DNA, 23 bp, Artificial Sequence
  Synthetic Construct
tctatggagactgccaaccgtta

SEQ ID NO: 28205 - DNA, 20 bp, Artificial Sequence
  Synthetic Construct
cccaccccatgcttgtcaac

SEQ ID NO: 28206 - DNA, 25 bp, Artificial Sequence
  Synthetic Construct
tttctcccttctccattccactatg

SEQ ID NO: 28207 - DNA, 20 bp, Artificial Sequence
  Synthetic Construct
actggcctggagaagctgat

SEQ ID NO: 28208 - DNA, 25 bp, Artificial Sequence
  Synthetic Construct
cacaaccagagaacttagcacatga

SEQ ID NO: 28209 - DNA, 24 bp, Artificial Sequence
  Synthetic Construct
tggagtgtttgaagagcaaagcta

SEQ ID NO: 28210 - DNA, 23 bp, Artificial Sequence
  Synthetic Construct
gcctcccctctgtcagacttttc

SEQ ID NO: 28211 - DNA, 19 bp, Artificial Sequence
  Synthetic Construct
tcggccagcactccacaga

SEQ ID NO: 28212 - DNA, 25 bp, Artificial Sequence
  Synthetic Construct
gaccctaaggaagtcatagcccata

SEQ ID NO: 28213 - DNA, 19 bp, Artificial Sequence
  Synthetic Construct
tggctgggtagggctgcat

SEQ ID NO: 28214 - DNA, 21 bp, Artificial Sequence
  Synthetic Construct
gcagtcacacttcctccaaca

SEQ ID NO: 28215 - DNA, 22 bp, Artificial Sequence
  Synthetic Construct
ctgaaggatgctggaagtggaa

SEQ ID NO: 28216 - DNA, 23 bp, Artificial Sequence
  Synthetic Construct
cttcaaagccagagctccatttc

SEQ ID NO: 28217 - DNA, 20 bp, Artificial Sequence
  Synthetic Construct
tggatcagccggtgcttgaa

SEQ ID NO: 28218 - DNA, 24 bp, Artificial Sequence
  Synthetic Construct
cacagtgagacacaatgaacacaa

SEQ ID NO: 28219 - DNA, 22 bp, Artificial Sequence
  Synthetic Construct
cttgggtaggcctaggtgttga

SEQ ID NO: 28220 - DNA, 20 bp, Artificial Sequence
  Synthetic Construct
gcagacacggcattgagaca

SEQ ID NO: 28221 - DNA, 20 bp, Artificial Sequence
  Synthetic Construct
acaccccacctcatcagtct

SEQ ID NO: 28222 - DNA, 19 bp, Artificial Sequence
  Synthetic Construct
ggcagcgggtagcttgtgt

SEQ ID NO: 28223 - DNA, 20 bp, Artificial Sequence
  Synthetic Construct
gcagggaccggagcctttat

SEQ ID NO: 28224 - DNA, 21 bp, Artificial Sequence
  Synthetic Construct
ccaccaagcctgccaaaattc

SEQ ID NO: 28225 - DNA, 20 bp, Artificial Sequence
  Synthetic Construct
tgctgtggccaggggaatgt

SEQ ID NO: 28226 - DNA, 26 bp, Artificial Sequence
  Synthetic Construct
cacatactctgtgcttctcactttct

SEQ ID NO: 28227 - DNA, 20 bp, Artificial Sequence
  Synthetic Construct
tctgaaccgcgctgcatttg

SEQ ID NO: 28228 - DNA, 21 bp, Artificial Sequence
  Synthetic Construct
tcttggcaggcagagttccta

SEQ ID NO: 28229 - DNA, 23 bp, Artificial Sequence
  Synthetic Construct
cctgcacccagtcctttctttac

SEQ ID NO: 28230 - DNA, 28 bp, Artificial Sequence
  Synthetic Construct
ctctggtccatgaactcatttccatttg

SEQ ID NO: 28231 - DNA, 22 bp, Artificial Sequence
  Synthetic Construct
gcagtgtggatcagcctgtact

SEQ ID NO: 28232 - DNA, 26 bp, Artificial Sequence
  Synthetic Construct
ctcagcaagaatcagtgactttccaa

SEQ ID NO: 28233 - DNA, 21 bp, Artificial Sequence
  Synthetic Construct
ccattccacagccagcacaga

SEQ ID NO: 28234 - DNA, 25 bp, Artificial Sequence
  Synthetic Construct
ggagacttagacccattggggaaca

SEQ ID NO: 28235 - DNA, 21 bp, Artificial Sequence
  Synthetic Construct
cagctgtctctgcttccaaca

SEQ ID NO: 28236 - DNA, 22 bp, Artificial Sequence
  Synthetic Construct
gtgagaattggcctgcacaaac

SEQ ID NO: 28237 - DNA, 23 bp, Artificial Sequence
  Synthetic Construct
cagtgcataggtttcaccaggaa

SEQ ID NO: 28238 - DNA, 25 bp, Artificial Sequence
  Synthetic Construct
ggatgggagatcacacagaccctat

SEQ ID NO: 28239 - DNA, 25 bp, Artificial Sequence
  Synthetic Construct
cggagcactcaccattctagacctt

SEQ ID NO: 28240 - DNA, 23 bp, Artificial Sequence
  Synthetic Construct
cccctgtctcttggttgttcctt

SEQ ID NO: 28241 - DNA, 27 bp, Artificial Sequence
  Synthetic Construct
ccagcttactgacttgtaaggatggtt

SEQ ID NO: 28242 - DNA, 23 bp, Artificial Sequence
  Synthetic Construct
tgtgaagggaagctttggaatca

SEQ ID NO: 28243 - DNA, 26 bp, Artificial Sequence
  Synthetic Construct
cacatggatagttcagtctccacaca

SEQ ID NO: 28244 - DNA, 23 bp, Artificial Sequence
  Synthetic Construct
gtctgcttccatgaacgtacaga

SEQ ID NO: 28245 - DNA, 26 bp, Artificial Sequence
  Synthetic Construct
gagaccttgttccctttatgcatctt

SEQ ID NO: 28246 - DNA, 25 bp, Artificial Sequence
  Synthetic Construct
gaggcataatcccaaatctctctgt

SEQ ID NO: 28247 - DNA, 25 bp, Artificial Sequence
  Synthetic Construct
gtgttatgtgtcaagccttctgttc

SEQ ID NO: 28248 - DNA, 30 bp, Artificial Sequence
  Synthetic Construct
gtctgtgagagaaacattccgtgaatcaat

SEQ ID NO: 28249 - DNA, 23 bp, Artificial Sequence
  Synthetic Construct
cctggttcacatgctgtggtgta

SEQ ID NO: 28250 - DNA, 21 bp, Artificial Sequence
  Synthetic Construct
gccaaggtgggtgtgcatctt

SEQ ID NO: 28251 - DNA, 21 bp, Artificial Sequence
  Synthetic Construct
agacagcctcggttctggaat

SEQ ID NO: 28252 - DNA, 27 bp, Artificial Sequence
  Synthetic Construct
ctctaggccagggactttaattacaca

SEQ ID NO: 28253 - DNA, 20 bp, Artificial Sequence
  Synthetic Construct
ggggtgttgcatctgtgcat

SEQ ID NO: 28254 - DNA, 25 bp, Artificial Sequence
  Synthetic Construct
gcaggaaataaagcaaggggatttg

SEQ ID NO: 28255 - DNA, 23 bp, Artificial Sequence
  Synthetic Construct
gctcattggcttccttactgtga

SEQ ID NO: 28256 - DNA, 22 bp, Artificial Sequence
  Synthetic Construct
cctgaagcactagcctgctcaa

SEQ ID NO: 28257 - DNA, 25 bp, Artificial Sequence
  Synthetic Construct
tgcattgcctggtatgaggaattag

SEQ ID NO: 28258 - DNA, 24 bp, Artificial Sequence
  Synthetic Construct
ctggtttccgctagagtcttgttc

SEQ ID NO: 28259 - DNA, 25 bp, Artificial Sequence
  Synthetic Construct
gcacggaaaagcaaaagctgataac

SEQ ID NO: 28260 - DNA, 21 bp, Artificial Sequence
  Synthetic Construct
tcagagaacggcaccggagat

SEQ ID NO: 28261 - DNA, 22 bp, Artificial Sequence
  Synthetic Construct
gagagcctgatgaccacaggaa

SEQ ID NO: 28262 - DNA, 26 bp, Artificial Sequence
  Synthetic Construct
gaacctgaaaggcattgaacgtaaca

SEQ ID NO: 28263 - DNA, 26 bp, Artificial Sequence
  Synthetic Construct
gtcaatatgcatgaccaggacctaga

SEQ ID NO: 28264 - DNA, 22 bp, Artificial Sequence
  Synthetic Construct
caggtggctagagtagctgcat

SEQ ID NO: 28265 - DNA, 22 bp, Artificial Sequence
  Synthetic Construct
ccttccttggcgtgcagtagat

SEQ ID NO: 28266 - DNA, 21 bp, Artificial Sequence
  Synthetic Construct
cccctgtcgccaatgatccta

SEQ ID NO: 28267 - DNA, 26 bp, Artificial Sequence
  Synthetic Construct
gattggcctactgcataattccctat

SEQ ID NO: 28268 - DNA, 26 bp, Artificial Sequence
  Synthetic Construct
ggtggaactttccttacagtcagaca

SEQ ID NO: 28269 - DNA, 22 bp, Artificial Sequence
  Synthetic Construct
gcaggagggagatttgtggaaa

SEQ ID NO: 28270 - DNA, 25 bp, Artificial Sequence
  Synthetic Construct
tgtgaactgttaggaagctgtcttt

SEQ ID NO: 28271 - DNA, 19 bp, Artificial Sequence
  Synthetic Construct
cccggccacaatggcatct

SEQ ID NO: 28272 - DNA, 20 bp, Artificial Sequence
  Synthetic Construct
gcaactggctccccttctct

SEQ ID NO: 28273 - DNA, 22 bp, Artificial Sequence
  Synthetic Construct
gctttgtcctccacctcctaag

SEQ ID NO: 28274 - DNA, 19 bp, Artificial Sequence
  Synthetic Construct
gcagcagcttctggtgcaa

SEQ ID NO: 28275 - DNA, 28 bp, Artificial Sequence
  Synthetic Construct
ggttggagataaaacacgtgtaggattg

SEQ ID NO: 28276 - DNA, 24 bp, Artificial Sequence
  Synthetic Construct
acaggcggaatgtaatatcgttct

SEQ ID NO: 28277 - DNA, 22 bp, Artificial Sequence
  Synthetic Construct
gcccagccagtgagcttatttc

SEQ ID NO: 28278 - DNA, 25 bp, Artificial Sequence
  Synthetic Construct
gccgcttggaaatcaatacactttg

SEQ ID NO: 28279 - DNA, 25 bp, Artificial Sequence
  Synthetic Construct
acccaggaattcatcacaaaactgt

SEQ ID NO: 28280 - DNA, 24 bp, Artificial Sequence
  Synthetic Construct
ccctgactgagaaccaaggactga

SEQ ID NO: 28281 - DNA, 25 bp, Artificial Sequence
  Synthetic Construct
acagaaggtaacagtctttcacagt

SEQ ID NO: 28282 - DNA, 21 bp, Artificial Sequence
  Synthetic Construct
ccagctggtggatggcagata

SEQ ID NO: 28283 - DNA, 21 bp, Artificial Sequence
  Synthetic Construct
ggcctcccctttctgcttctt

SEQ ID NO: 28284 - DNA, 21 bp, Artificial Sequence
  Synthetic Construct
agctcccagctgtgcagtcta

SEQ ID NO: 28285 - DNA, 23 bp, Artificial Sequence
  Synthetic Construct
gtggcagattgattccctcagat

SEQ ID NO: 28286 - DNA, 23 bp, Artificial Sequence
  Synthetic Construct
gaaccctccactgtccttgttag

SEQ ID NO: 28287 - DNA, 24 bp, Artificial Sequence
  Synthetic Construct
gtgaggatgaccagaggtctcttt

SEQ ID NO: 28288 - DNA, 19 bp, Artificial Sequence
  Synthetic Construct
cgcgggaaatgcgggaaat

SEQ ID NO: 28289 - DNA, 30 bp, Artificial Sequence
  Synthetic Construct
gactgaccactgatacttcctgttaaatca

SEQ ID NO: 28290 - DNA, 24 bp, Artificial Sequence
  Synthetic Construct
tgcaactttgcaggtaaagaggat

SEQ ID NO: 28291 - DNA, 23 bp, Artificial Sequence
  Synthetic Construct
gggataggcgaagagtagacaga

SEQ ID NO: 28292 - DNA, 22 bp, Artificial Sequence
  Synthetic Construct
caggtggattgcaagacaggaa

SEQ ID NO: 28293 - DNA, 22 bp, Artificial Sequence
  Synthetic Construct
tggggcttttgtaaagcgacat

SEQ ID NO: 28294 - DNA, 22 bp, Artificial Sequence
  Synthetic Construct
aggatagagaggggccaaatgt

SEQ ID NO: 28295 - DNA, 22 bp, Artificial Sequence
  Synthetic Construct
agggaaggactcccagggaaaa

SEQ ID NO: 28296 - DNA, 24 bp, Artificial Sequence
  Synthetic Construct
gaaagtgcggatggaatggaattg

SEQ ID NO: 28297 - DNA, 25 bp, Artificial Sequence
  Synthetic Construct
ctgttgagatgaaaagggagtggat

SEQ ID NO: 28298 - DNA, 21 bp, Artificial Sequence
  Synthetic Construct
ctttgggcagacctagagcaa

SEQ ID NO: 28299 - DNA, 21 bp, Artificial Sequence
  Synthetic Construct
ggaagccacagaccctcaaat

SEQ ID NO: 28300 - DNA, 27 bp, Artificial Sequence
  Synthetic Construct
gctagaacatcatacatcgaggcatac

SEQ ID NO: 28301 - DNA, 24 bp, Artificial Sequence
  Synthetic Construct
gcctgagctgcattcagacatagt

SEQ ID NO: 28302 - DNA, 26 bp, Artificial Sequence
  Synthetic Construct
gcctggggaattataaggaagggatt

SEQ ID NO: 28303 - DNA, 21 bp, Artificial Sequence
  Synthetic Construct
actaaccctcccctccagtgt

SEQ ID NO: 28304 - DNA, 21 bp, Artificial Sequence
  Synthetic Construct
cgcaagtctgcattccaacaa

SEQ ID NO: 28305 - DNA, 26 bp, Artificial Sequence
  Synthetic Construct
ctgggaatctagttagagaggctgta

SEQ ID NO: 28306 - DNA, 26 bp, Artificial Sequence
  Synthetic Construct
cgacttcaccatcttccttcgtctct

SEQ ID NO: 28307 - DNA, 28 bp, Artificial Sequence
  Synthetic Construct
ccattcagagctcttgactcaatgatac

SEQ ID NO: 28308 - DNA, 27 bp, Artificial Sequence
  Synthetic Construct
gagcagagaagacacctcatatagctt

SEQ ID NO: 28309 - DNA, 20 bp, Artificial Sequence
  Synthetic Construct
tagtggcgaggaggcgagtt

SEQ ID NO: 28310 - DNA, 26 bp, Artificial Sequence
  Synthetic Construct
gagtctgaagcccacaactattttca

SEQ ID NO: 28311 - DNA, 20 bp, Artificial Sequence
  Synthetic Construct
gcaagcagctggcagttgaa

SEQ ID NO: 28312 - DNA, 22 bp, Artificial Sequence
  Synthetic Construct
tgcctggttacctcccatttac

SEQ ID NO: 28313 - DNA, 24 bp, Artificial Sequence
  Synthetic Construct
gcacagaccaaccttggtagtaac

SEQ ID NO: 28314 - DNA, 24 bp, Artificial Sequence
  Synthetic Construct
tcagagggtgaagaggaagttttc

SEQ ID NO: 28315 - DNA, 23 bp, Artificial Sequence
  Synthetic Construct
gtgatgggctgatggtacctctt

SEQ ID NO: 28316 - DNA, 22 bp, Artificial Sequence
  Synthetic Construct
tgatcccaggacaaacacgatt

SEQ ID NO: 28317 - DNA, 22 bp, Artificial Sequence
  Synthetic Construct
ccacaccacggtcttgtcttag

SEQ ID NO: 28318 - DNA, 20 bp, Artificial Sequence
  Synthetic Construct
tgaggcactcccgcctttga

SEQ ID NO: 28319 - DNA, 25 bp, Artificial Sequence
  Synthetic Construct
ctgagaggacatttgatgggtctaa

SEQ ID NO: 28320 - DNA, 22 bp, Artificial Sequence
  Synthetic Construct
gtggcggtgaatgcctgtaatc

SEQ ID NO: 28321 - DNA, 27 bp, Artificial Sequence
  Synthetic Construct
caagtatctggacaagctgataaggaa

SEQ ID NO: 28322 - DNA, 20 bp, Artificial Sequence
  Synthetic Construct
gccagtggattctgcgtcaa

SEQ ID NO: 28323 - DNA, 24 bp, Artificial Sequence
  Synthetic Construct
gcattccaggatgggaaaaccata

SEQ ID NO: 28324 - DNA, 27 bp, Artificial Sequence
  Synthetic Construct
gtctttccaaagtttcatccacacatc

SEQ ID NO: 28325 - DNA, 29 bp, Artificial Sequence
  Synthetic Construct
ccccacatactctctgtgttattgagatg

SEQ ID NO: 28326 - DNA, 25 bp, Artificial Sequence
  Synthetic Construct
ccagtgtgacatgactaggatgttg

SEQ ID NO: 28327 - DNA, 23 bp, Artificial Sequence
  Synthetic Construct
tctgacactgagttgggaaggaa

SEQ ID NO: 28328 - DNA, 26 bp, Artificial Sequence
  Synthetic Construct
ctggttctgctaacattggtgtcaac

SEQ ID NO: 28329 - DNA, 22 bp, Artificial Sequence
  Synthetic Construct
ggggcaagggctgcaaaagtaa

SEQ ID NO: 28330 - DNA, 25 bp, Artificial Sequence
  Synthetic Construct
ggtgcctaccctatgtgatttctga

SEQ ID NO: 28331 - DNA, 20 bp, Artificial Sequence
  Synthetic Construct
actgccctgtgacactggaa

SEQ ID NO: 28332 - DNA, 30 bp, Artificial Sequence
  Synthetic Construct
gagctaaagtctgaggaggttctgttttta

SEQ ID NO: 28333 - DNA, 21 bp, Artificial Sequence
  Synthetic Construct
tggaatggtgtagcccagtga

SEQ ID NO: 28334 - DNA, 24 bp, Artificial Sequence
  Synthetic Construct
gacctgctcaatgcttctggtaag

SEQ ID NO: 28335 - DNA, 23 bp, Artificial Sequence
  Synthetic Construct
ggggacagctttgattccctatg

SEQ ID NO: 28336 - DNA, 23 bp, Artificial Sequence
  Synthetic Construct
cacagcgtaggcaatgattcttc

SEQ ID NO: 28337 - DNA, 22 bp, Artificial Sequence
  Synthetic Construct
gcctggtggaactggctattgt

SEQ ID NO: 28338 - DNA, 24 bp, Artificial Sequence
  Synthetic Construct
ctgtatcccaccagagttggttag

SEQ ID NO: 28339 - DNA, 22 bp, Artificial Sequence
  Synthetic Construct
tctgccccttctagctctgctt

SEQ ID NO: 28340 - DNA, 23 bp, Artificial Sequence
  Synthetic Construct
ccccagctcttctcttcctagat

SEQ ID NO: 28341 - DNA, 26 bp, Artificial Sequence
  Synthetic Construct
ccacttagtcctttcagcagccaaat

SEQ ID NO: 28342 - DNA, 21 bp, Artificial Sequence
  Synthetic Construct
gcagttggcaagctggagact

SEQ ID NO: 28343 - DNA, 25 bp, Artificial Sequence
  Synthetic Construct
gaaagagacacacaacaaggctatg

SEQ ID NO: 28344 - DNA, 23 bp, Artificial Sequence
  Synthetic Construct
gggtggagtgaagccaattccaa

SEQ ID NO: 28345 - DNA, 20 bp, Artificial Sequence
  Synthetic Construct
agtgggtgtgcagtttgctt

SEQ ID NO: 28346 - DNA, 23 bp, Artificial Sequence
  Synthetic Construct
ggtggtagagcagagtccagtgt

SEQ ID NO: 28347 - DNA, 27 bp, Artificial Sequence
  Synthetic Construct
cttcaaaagttatgctgtggtggtaga

SEQ ID NO: 28348 - DNA, 26 bp, Artificial Sequence
  Synthetic Construct
gctgtctttgtggtctagattgcttt

SEQ ID NO: 28349 - DNA, 20 bp, Artificial Sequence
  Synthetic Construct
tttcctctggccctgaccat

SEQ ID NO: 28350 - DNA, 26 bp, Artificial Sequence
  Synthetic Construct
gggaaacaaagtcaatcctccatttc

SEQ ID NO: 28351 - DNA, 27 bp, Artificial Sequence
  Synthetic Construct
ggggagttaatcagatttgctttgaga

SEQ ID NO: 28352 - DNA, 24 bp, Artificial Sequence
  Synthetic Construct
gtggtgagacttggaaaggggttt

SEQ ID NO: 28353 - DNA, 25 bp, Artificial Sequence
  Synthetic Construct
gtggttaatggaaaacagggcatag

SEQ ID NO: 28354 - DNA, 26 bp, Artificial Sequence
  Synthetic Construct
cacctggatatttcagaagcccttga

SEQ ID NO: 28355 - DNA, 23 bp, Artificial Sequence
  Synthetic Construct
cctaagtcactccacaggacaca

SEQ ID NO: 28356 - DNA, 24 bp, Artificial Sequence
  Synthetic Construct
ctgagctaggtagcctgctctaaa

SEQ ID NO: 28357 - DNA, 24 bp, Artificial Sequence
  Synthetic Construct
ggactacttgcgttttgattgcta

SEQ ID NO: 28358 - DNA, 25 bp, Artificial Sequence
  Synthetic Construct
gaagtcacgcattgaatcagagtag

SEQ ID NO: 28359 - DNA, 27 bp, Artificial Sequence
  Synthetic Construct
ctctttgagcttggagtctctaataca

SEQ ID NO: 28360 - DNA, 24 bp, Artificial Sequence
  Synthetic Construct
gtgttcagcctctgcctatttttc

SEQ ID NO: 28361 - DNA, 24 bp, Artificial Sequence
  Synthetic Construct
gggcctttttacatgttccagaag

SEQ ID NO: 28362 - DNA, 24 bp, Artificial Sequence
  Synthetic Construct
gtgagtcatgccaagatgagattg

SEQ ID NO: 28363 - DNA, 24 bp, Artificial Sequence
  Synthetic Construct
cagtacacggaagctgatgtaaga

SEQ ID NO: 28364 - DNA, 22 bp, Artificial Sequence
  Synthetic Construct
gagaacagcaccaagcctctca

SEQ ID NO: 28365 - DNA, 25 bp, Artificial Sequence
  Synthetic Construct
ggactgagacaggggttttaactga

SEQ ID NO: 28366 - DNA, 18 bp, Artificial Sequence
  Synthetic Construct
agacacacggggcctttg

SEQ ID NO: 28367 - DNA, 23 bp, Artificial Sequence
  Synthetic Construct
ggagcattttgacgtgggtgatt

SEQ ID NO: 28368 - DNA, 23 bp, Artificial Sequence
  Synthetic Construct
tggtttgggttctgaatgacaca

SEQ ID NO: 28369 - DNA, 28 bp, Artificial Sequence
  Synthetic Construct
ctgtcttaggaataaggcgaggttgaag

SEQ ID NO: 28370 - DNA, 23 bp, Artificial Sequence
  Synthetic Construct
gtgccactacagctggaaaggat

SEQ ID NO: 28371 - DNA, 20 bp, Artificial Sequence
  Synthetic Construct
caccaaggccaatcccttca

SEQ ID NO: 28372 - DNA, 25 bp, Artificial Sequence
  Synthetic Construct
gtgggtgagctacttttctcaggat

SEQ ID NO: 28373 - DNA, 24 bp, Artificial Sequence
  Synthetic Construct
cccattgtagaccatttgctctct

SEQ ID NO: 28374 - DNA, 24 bp, Artificial Sequence
  Synthetic Construct
ggccctgccattcaaaatcacctt

SEQ ID NO: 28375 - DNA, 24 bp, Artificial Sequence
  Synthetic Construct
ccataccatgcaggcttactcaag

SEQ ID NO: 28376 - DNA, 21 bp, Artificial Sequence
  Synthetic Construct
caccatggctactgacccatt

SEQ ID NO: 28377 - DNA, 20 bp, Artificial Sequence
  Synthetic Construct
ttggggctcggaaggaacat

SEQ ID NO: 28378 - DNA, 26 bp, Artificial Sequence
  Synthetic Construct
gggagtgtgactgtagagaatgttag

SEQ ID NO: 28379 - DNA, 23 bp, Artificial Sequence
  Synthetic Construct
ggcagagcaggagactaggaaca

SEQ ID NO: 28380 - DNA, 22 bp, Artificial Sequence
  Synthetic Construct
tggctgaggggtcagttttatg

SEQ ID NO: 28381 - DNA, 23 bp, Artificial Sequence
  Synthetic Construct
ctgtgaacacaggaagtccaaga

SEQ ID NO: 28382 - DNA, 24 bp, Artificial Sequence
  Synthetic Construct
caacgccagacctttcttatttgt

SEQ ID NO: 28383 - DNA, 26 bp, Artificial Sequence
  Synthetic Construct
gttcttaggatcctgtcctgctttac

SEQ ID NO: 28384 - DNA, 24 bp, Artificial Sequence
  Synthetic Construct
ctgccctggtaaatatccaactga

SEQ ID NO: 28385 - DNA, 27 bp, Artificial Sequence
  Synthetic Construct
gtgggactagagaacatatctgtgaga

SEQ ID NO: 28386 - DNA, 24 bp, Artificial Sequence
  Synthetic Construct
tgttttgcctgacatcttgagtga

SEQ ID NO: 28387 - DNA, 23 bp, Artificial Sequence
  Synthetic Construct
tcttgttgctcttgaaggcattg

SEQ ID NO: 28388 - DNA, 24 bp, Artificial Sequence
  Synthetic Construct
gttgctttgcattccaagcctttc

SEQ ID NO: 28389 - DNA, 22 bp, Artificial Sequence
  Synthetic Construct
ggagggaaaatgcactgagaca

SEQ ID NO: 28390 - DNA, 21 bp, Artificial Sequence
  Synthetic Construct
ccgatgggatgtggaggtgat

SEQ ID NO: 28391 - DNA, 24 bp, Artificial Sequence
  Synthetic Construct
tctggtcttaggctggagattagt

SEQ ID NO: 28392 - DNA, 24 bp, Artificial Sequence
  Synthetic Construct
ggtgagtgccatgttgtttactgt

SEQ ID NO: 28393 - DNA, 22 bp, Artificial Sequence
  Synthetic Construct
tgtgccagccttctgtatcttg

SEQ ID NO: 28394 - DNA, 22 bp, Artificial Sequence
  Synthetic Construct
gatccttcccactcgaggaaac

SEQ ID NO: 28395 - DNA, 22 bp, Artificial Sequence
  Synthetic Construct
aggatcccaatcctagctgtca

SEQ ID NO: 28396 - DNA, 22 bp, Artificial Sequence
  Synthetic Construct
tggttgggagacacacggagat

SEQ ID NO: 28397 - DNA, 20 bp, Artificial Sequence
  Synthetic Construct
tgggcagagtgcttggaaag

SEQ ID NO: 28398 - DNA, 26 bp, Artificial Sequence
  Synthetic Construct
accaaccagtaaagtccagtaaccta

SEQ ID NO: 28399 - DNA, 22 bp, Artificial Sequence
  Synthetic Construct
agctccccaggcaattcaggta

SEQ ID NO: 28400 - DNA, 22 bp, Artificial Sequence
  Synthetic Construct
gtgcccttttccctgtccagaa

SEQ ID NO: 28401 - DNA, 20 bp, Artificial Sequence
  Synthetic Construct
aggcctccaggacagggaaa

SEQ ID NO: 28402 - DNA, 28 bp, Artificial Sequence
  Synthetic Construct
ggtgcaaatagggtgtgattagaaggaa

SEQ ID NO: 28403 - DNA, 26 bp, Artificial Sequence
  Synthetic Construct
cagaagcttgatgacttcccaagaac

SEQ ID NO: 28404 - DNA, 23 bp, Artificial Sequence
  Synthetic Construct
gagaaaccaaaacccaggtctgt

SEQ ID NO: 28405 - DNA, 23 bp, Artificial Sequence
  Synthetic Construct
gtgccctaacttggtgcttctct

SEQ ID NO: 28406 - DNA, 21 bp, Artificial Sequence
  Synthetic Construct
ggaggtgtgtctggcttgcat

SEQ ID NO: 28407 - DNA, 22 bp, Artificial Sequence
  Synthetic Construct
ccaaccggacacctctcataca

SEQ ID NO: 28408 - DNA, 22 bp, Artificial Sequence
  Synthetic Construct
ctcctggggtccctttttctct

SEQ ID NO: 28409 - DNA, 24 bp, Artificial Sequence
  Synthetic Construct
ggcctttatttgttcctggtcagt

SEQ ID NO: 28410 - DNA, 27 bp, Artificial Sequence
  Synthetic Construct
gacttaagtttaaaacccaggctgttc

SEQ ID NO: 28411 - DNA, 23 bp, Artificial Sequence
  Synthetic Construct
ccagtggagatgcctgcaaatca

SEQ ID NO: 28412 - DNA, 20 bp, Artificial Sequence
  Synthetic Construct
ggagccctatgggccatcaa

SEQ ID NO: 28413 - DNA, 21 bp, Artificial Sequence
  Synthetic Construct
gggctggaaccaatggctagt

SEQ ID NO: 28414 - DNA, 24 bp, Artificial Sequence
  Synthetic Construct
ggaaaccacttggaatctggtagt

SEQ ID NO: 28415 - DNA, 24 bp, Artificial Sequence
  Synthetic Construct
gggagcagaaagaggagatcttag

SEQ ID NO: 28416 - DNA, 22 bp, Artificial Sequence
  Synthetic Construct
cctggttttcagggagggaaga

SEQ ID NO: 28417 - DNA, 18 bp, Artificial Sequence
  Synthetic Construct
tcgctgagggctgtctct

SEQ ID NO: 28418 - DNA, 22 bp, Artificial Sequence
  Synthetic Construct
tggcggggaagactaacgtttc

SEQ ID NO: 28419 - DNA, 28 bp, Artificial Sequence
  Synthetic Construct
gcttcctaccttcagtagtatcagtagt

SEQ ID NO: 28420 - DNA, 21 bp, Artificial Sequence
  Synthetic Construct
tggggatcacaaggacgaaag

SEQ ID NO: 28421 - DNA, 22 bp, Artificial Sequence
  Synthetic Construct
agccctcaccccatttctggat

SEQ ID NO: 28422 - DNA, 24 bp, Artificial Sequence
  Synthetic Construct
cccactgctaacactgacatagaa

SEQ ID NO: 28423 - DNA, 24 bp, Artificial Sequence
  Synthetic Construct
gcaagctcagagggcttattcaag

SEQ ID NO: 28424 - DNA, 27 bp, Artificial Sequence
  Synthetic Construct
ggaaggaaatgatagagagaggcattg

SEQ ID NO: 28425 - DNA, 22 bp, Artificial Sequence
  Synthetic Construct
gagggtaagtggctcagagagt

SEQ ID NO: 28426 - DNA, 22 bp, Artificial Sequence
  Synthetic Construct
gctttctatcaggctcccagtt

SEQ ID NO: 28427 - DNA, 22 bp, Artificial Sequence
  Synthetic Construct
ggctgggcctctaccttttgaa

SEQ ID NO: 28428 - DNA, 27 bp, Artificial Sequence
  Synthetic Construct
gctcgggttaaagtttcactgaatatg

SEQ ID NO: 28429 - DNA, 26 bp, Artificial Sequence
  Synthetic Construct
cggtcctatccattagaagggagtct

SEQ ID NO: 28430 - DNA, 23 bp, Artificial Sequence
  Synthetic Construct
gtgctgaaaagtctgtgcctaag

SEQ ID NO: 28431 - DNA, 21 bp, Artificial Sequence
  Synthetic Construct
ggtgtgccctgcttggatact

SEQ ID NO: 28432 - DNA, 26 bp, Artificial Sequence
  Synthetic Construct
ctgcatgcatactttaggcacatatc

SEQ ID NO: 28433 - DNA, 22 bp, Artificial Sequence
  Synthetic Construct
aggtaggttgaggccagattgt

SEQ ID NO: 28434 - DNA, 22 bp, Artificial Sequence
  Synthetic Construct
cccattcagccacacgcattac

SEQ ID NO: 28435 - DNA, 27 bp, Artificial Sequence
  Synthetic Construct
caaggtggtttaatcttcactggatgt

SEQ ID NO: 28436 - DNA, 20 bp, Artificial Sequence
  Synthetic Construct
tggtaggcatagcggcagtt

SEQ ID NO: 28437 - DNA, 22 bp, Artificial Sequence
  Synthetic Construct
caccctggggataggaaggtaa

SEQ ID NO: 28438 - DNA, 22 bp, Artificial Sequence
  Synthetic Construct
tgccttcatcctccctgtctct

SEQ ID NO: 28439 - DNA, 21 bp, Artificial Sequence
  Synthetic Construct
ggggcatgttgcctcagtttc

SEQ ID NO: 28440 - DNA, 25 bp, Artificial Sequence
  Synthetic Construct
ccatgatctccaaaagaccttgctt

SEQ ID NO: 28441 - DNA, 24 bp, Artificial Sequence
  Synthetic Construct
tgaatgccattacctctctgtgtt

SEQ ID NO: 28442 - DNA, 26 bp, Artificial Sequence
  Synthetic Construct
ggacagcaatttctgggttaaaggat

SEQ ID NO: 28443 - DNA, 24 bp, Artificial Sequence
  Synthetic Construct
gcttctgtaccaggagtggcttac

SEQ ID NO: 28444 - DNA, 24 bp, Artificial Sequence
  Synthetic Construct
ttcccctccaatctcaaggtttac

SEQ ID NO: 28445 - DNA, 24 bp, Artificial Sequence
  Synthetic Construct
gcaagtaaagggctcagtggctat

SEQ ID NO: 28446 - DNA, 22 bp, Artificial Sequence
  Synthetic Construct
agatctaggccctctggtttca

SEQ ID NO: 28447 - DNA, 20 bp, Artificial Sequence
  Synthetic Construct
tccctgagcttcccctccaa

SEQ ID NO: 28448 - DNA, 25 bp, Artificial Sequence
  Synthetic Construct
ccccagatttgtaccacagaaatca

SEQ ID NO: 28449 - DNA, 23 bp, Artificial Sequence
  Synthetic Construct
cctgtaggagaaaagcagtcagt

SEQ ID NO: 28450 - DNA, 23 bp, Artificial Sequence
  Synthetic Construct
cagctgaatgcatgagggtgaca

SEQ ID NO: 28451 - DNA, 24 bp, Artificial Sequence
  Synthetic Construct
ctctttgtgagccaagctgctaaa

SEQ ID NO: 28452 - DNA, 25 bp, Artificial Sequence
  Synthetic Construct
cagcaggagaaattcttgcctaaca

SEQ ID NO: 28453 - DNA, 23 bp, Artificial Sequence
  Synthetic Construct
ggttattggcaattgctgtggat

SEQ ID NO: 28454 - DNA, 26 bp, Artificial Sequence
  Synthetic Construct
cggactaatacactcagacagacttc

SEQ ID NO: 28455 - DNA, 22 bp, Artificial Sequence
  Synthetic Construct
cctgttccctcttgcagtgctt

SEQ ID NO: 28456 - DNA, 24 bp, Artificial Sequence
  Synthetic Construct
ccctgtaagcactcatcacacgtt

SEQ ID NO: 28457 - DNA, 26 bp, Artificial Sequence
  Synthetic Construct
ccccaatacacagactctccatgtca

SEQ ID NO: 28458 - DNA, 22 bp, Artificial Sequence
  Synthetic Construct
agctaagcagagctggggattc

SEQ ID NO: 28459 - DNA, 30 bp, Artificial Sequence
  Synthetic Construct
ctgcttacaaattactgggctagttgatct

SEQ ID NO: 28460 - DNA, 22 bp, Artificial Sequence
  Synthetic Construct
gcctcctgtaaggatgttggaa

SEQ ID NO: 28461 - DNA, 24 bp, Artificial Sequence
  Synthetic Construct
tgagctgagtttagcttggtacat

SEQ ID NO: 28462 - DNA, 24 bp, Artificial Sequence
  Synthetic Construct
caagtgaagacttggttgctgaca

SEQ ID NO: 28463 - DNA, 24 bp, Artificial Sequence
  Synthetic Construct
tcctaactgcactggtgtgataag

SEQ ID NO: 28464 - DNA, 20 bp, Artificial Sequence
  Synthetic Construct
gctgccttgcagggtttctt

SEQ ID NO: 28465 - DNA, 25 bp, Artificial Sequence
  Synthetic Construct
cagtacacttaaacccaggcaagaa

SEQ ID NO: 28466 - DNA, 23 bp, Artificial Sequence
  Synthetic Construct
tgagtcattaggcaagggctcta

SEQ ID NO: 28467 - DNA, 19 bp, Artificial Sequence
  Synthetic Construct
gcactggggcaaggcagaa

SEQ ID NO: 28468 - DNA, 25 bp, Artificial Sequence
  Synthetic Construct
ggcttgacacacctttaatgacact

SEQ ID NO: 28469 - DNA, 23 bp, Artificial Sequence
  Synthetic Construct
tgcaagagaggaggagagatgaa

SEQ ID NO: 28470 - DNA, 22 bp, Artificial Sequence
  Synthetic Construct
caaaaaggcactgcacttggaa

SEQ ID NO: 28471 - DNA, 24 bp, Artificial Sequence
  Synthetic Construct
ggtaggtatgaagtcaggggaaag

SEQ ID NO: 28472 - DNA, 20 bp, Artificial Sequence
  Synthetic Construct
gggtagctccagagggcaat

SEQ ID NO: 28473 - DNA, 20 bp, Artificial Sequence
  Synthetic Construct
ccatgaccctgggaccgttt

SEQ ID NO: 28474 - DNA, 24 bp, Artificial Sequence
  Synthetic Construct
gacaacattcccaagttcccaaac

SEQ ID NO: 28475 - DNA, 24 bp, Artificial Sequence
  Synthetic Construct
gatttccactgtgttgctctgaaa

SEQ ID NO: 28476 - DNA, 23 bp, Artificial Sequence
  Synthetic Construct
gggatactcagtctgcattgctt

SEQ ID NO: 28477 - DNA, 22 bp, Artificial Sequence
  Synthetic Construct
ggcctgggctgactttcataag

SEQ ID NO: 28478 - DNA, 20 bp, Artificial Sequence
  Synthetic Construct
tgtgcgagggctggtacata

SEQ ID NO: 28479 - DNA, 22 bp, Artificial Sequence
  Synthetic Construct
caggagaggttgggatgcttag

SEQ ID NO: 28480 - DNA, 23 bp, Artificial Sequence
  Synthetic Construct
gcctacagcttagtggggaaaga

SEQ ID NO: 28481 - DNA, 24 bp, Artificial Sequence
  Synthetic Construct
gagaacaaacgggtctgaatgaca

SEQ ID NO: 28482 - DNA, 20 bp, Artificial Sequence
  Synthetic Construct
gagaactgaacggccacact

SEQ ID NO: 28483 - DNA, 24 bp, Artificial Sequence
  Synthetic Construct
cgggcacttgcttctctgagatta

SEQ ID NO: 28484 - DNA, 23 bp, Artificial Sequence
  Synthetic Construct
ggctttgcaggaaatggcatcta

SEQ ID NO: 28485 - DNA, 25 bp, Artificial Sequence
  Synthetic Construct
aggctcagctagagaaaaccattag

SEQ ID NO: 28486 - DNA, 25 bp, Artificial Sequence
  Synthetic Construct
ggctgcagtaatgaagggtaagcta

SEQ ID NO: 28487 - DNA, 24 bp, Artificial Sequence
  Synthetic Construct
ggggaaccccttgacttgtagttg

SEQ ID NO: 28488 - DNA, 20 bp, Artificial Sequence
  Synthetic Construct
gctcacagaagctgcacgta

SEQ ID NO: 28489 - DNA, 22 bp, Artificial Sequence
  Synthetic Construct
cttctcactcaccatgccagat

SEQ ID NO: 28490 - DNA, 22 bp, Artificial Sequence
  Synthetic Construct
ttcgcacttcctctcggaaaat

SEQ ID NO: 28491 - DNA, 24 bp, Artificial Sequence
  Synthetic Construct
cagatctcatttctggcacagttc

SEQ ID NO: 28492 - DNA, 25 bp, Artificial Sequence
  Synthetic Construct
ggccattaagatggcatgctgatac

SEQ ID NO: 28493 - DNA, 24 bp, Artificial Sequence
  Synthetic Construct
tctcaggatcacaatccaccacta

SEQ ID NO: 28494 - DNA, 26 bp, Artificial Sequence
  Synthetic Construct
ctgatggtgaaaagccaggtatagtt

SEQ ID NO: 28495 - DNA, 22 bp, Artificial Sequence
  Synthetic Construct
caggataccaggctgcacttca

SEQ ID NO: 28496 - DNA, 22 bp, Artificial Sequence
  Synthetic Construct
gccaagatctgcgggacctttt

SEQ ID NO: 28497 - DNA, 22 bp, Artificial Sequence
  Synthetic Construct
aggcttcccacaccctgagtta

SEQ ID NO: 28498 - DNA, 21 bp, Artificial Sequence
  Synthetic Construct
agacatgagagtggcgctttg

SEQ ID NO: 28499 - DNA, 22 bp, Artificial Sequence
  Synthetic Construct
ccctccaaatcctgccacacaa

SEQ ID NO: 28500 - DNA, 23 bp, Artificial Sequence
  Synthetic Construct
gagtccatcctttggggtgtttg

SEQ ID NO: 28501 - DNA, 23 bp, Artificial Sequence
  Synthetic Construct
aagtgcaaccttggagagtaaca

SEQ ID NO: 28502 - DNA, 25 bp, Artificial Sequence
  Synthetic Construct
gcaacttgtccaagcatagttcaca

SEQ ID NO: 28503 - DNA, 26 bp, Artificial Sequence
  Synthetic Construct
gtccaagatcaaggcaccatttttgt

SEQ ID NO: 28504 - DNA, 22 bp, Artificial Sequence
  Synthetic Construct
gtttctggcttcagtgcttgtt

SEQ ID NO: 28505 - DNA, 19 bp, Artificial Sequence
  Synthetic Construct
gcaggggatgaggctctgt

SEQ ID NO: 28506 - DNA, 26 bp, Artificial Sequence
  Synthetic Construct
ccgatttggcatcagttgaaccctta

SEQ ID NO: 28507 - DNA, 22 bp, Artificial Sequence
  Synthetic Construct
ttccgcaactggagagatttga

SEQ ID NO: 28508 - DNA, 22 bp, Artificial Sequence
  Synthetic Construct
ctgggctgagtgggtggaataa

SEQ ID NO: 28509 - DNA, 24 bp, Artificial Sequence
  Synthetic Construct
agcatttcctcgtgctatgttagt

SEQ ID NO: 28510 - DNA, 25 bp, Artificial Sequence
  Synthetic Construct
ggggctcaggaacttttaagtgaca

SEQ ID NO: 28511 - DNA, 22 bp, Artificial Sequence
  Synthetic Construct
agtgtgacagcgcattctatga

SEQ ID NO: 28512 - DNA, 27 bp, Artificial Sequence
  Synthetic Construct
tctgagtcatgtacccttatctagctt

SEQ ID NO: 28513 - DNA, 25 bp, Artificial Sequence
  Synthetic Construct
cacaaggagccacatttgatgtact

SEQ ID NO: 28514 - DNA, 22 bp, Artificial Sequence
  Synthetic Construct
ggacgtatcttccaccgtgctt

SEQ ID NO: 28515 - DNA, 20 bp, Artificial Sequence
  Synthetic Construct
gcaactgcctcaaccagcat

SEQ ID NO: 28516 - DNA, 21 bp, Artificial Sequence
  Synthetic Construct
tggggcctggaattctcttgt

SEQ ID NO: 28517 - DNA, 27 bp, Artificial Sequence
  Synthetic Construct
gggagccaaactcaaattctactaaga

SEQ ID NO: 28518 - DNA, 25 bp, Artificial Sequence
  Synthetic Construct
ggctctttggagtccattcttctct

SEQ ID NO: 28519 - DNA, 24 bp, Artificial Sequence
  Synthetic Construct
tcccaggaaagttcatggtttaca

SEQ ID NO: 28520 - DNA, 22 bp, Artificial Sequence
  Synthetic Construct
gcaggcacagccttttacattg

SEQ ID NO: 28521 - DNA, 24 bp, Artificial Sequence
  Synthetic Construct
ctcatgtcatttcactcccacact

SEQ ID NO: 28522 - DNA, 25 bp, Artificial Sequence
  Synthetic Construct
ggaagcatggtccttcctagtggat

SEQ ID NO: 28523 - DNA, 24 bp, Artificial Sequence
  Synthetic Construct
ggataaggaggcccaagtcctaga

SEQ ID NO: 28524 - DNA, 24 bp, Artificial Sequence
  Synthetic Construct
acgtgatttcatctgcgtcttaca

SEQ ID NO: 28525 - DNA, 23 bp, Artificial Sequence
  Synthetic Construct
gtgggaatagcagggaagcagat

SEQ ID NO: 28526 - DNA, 20 bp, Artificial Sequence
  Synthetic Construct
tggtgctggcttgccattct

SEQ ID NO: 28527 - DNA, 24 bp, Artificial Sequence
  Synthetic Construct
tcttaggctttccacacctcaatg

SEQ ID NO: 28528 - DNA, 20 bp, Artificial Sequence
  Synthetic Construct
cgtggagtcaccccaagact

SEQ ID NO: 28529 - DNA, 23 bp, Artificial Sequence
  Synthetic Construct
gtccccaagctccctgttgttta

SEQ ID NO: 28530 - DNA, 22 bp, Artificial Sequence
  Synthetic Construct
ctgctcccttcctgagttcatc

SEQ ID NO: 28531 - DNA, 24 bp, Artificial Sequence
  Synthetic Construct
catattgtcagcggctacttttgt

SEQ ID NO: 28532 - DNA, 26 bp, Artificial Sequence
  Synthetic Construct
gggactcagtagttttggagccctta

SEQ ID NO: 28533 - DNA, 22 bp, Artificial Sequence
  Synthetic Construct
gcagtcaatactctggggtgaa

SEQ ID NO: 28534 - DNA, 24 bp, Artificial Sequence
  Synthetic Construct
aatagagtggcacccatactcttg

SEQ ID NO: 28535 - DNA, 21 bp, Artificial Sequence
  Synthetic Construct
tccagatggggacaccctact

SEQ ID NO: 28536 - DNA, 27 bp, Artificial Sequence
  Synthetic Construct
ccgatgtcacctaatttcagaggcaaa

SEQ ID NO: 28537 - DNA, 21 bp, Artificial Sequence
  Synthetic Construct
ccactcccaccatcaccttgt

SEQ ID NO: 28538 - DNA, 23 bp, Artificial Sequence
  Synthetic Construct
gccaggtgcctacctaaaagcta

SEQ ID NO: 28539 - DNA, 22 bp, Artificial Sequence
  Synthetic Construct
gagcacttccctcttcccatca

SEQ ID NO: 28540 - DNA, 21 bp, Artificial Sequence
  Synthetic Construct
cctgcaaaggcaggtcaccat

SEQ ID NO: 28541 - DNA, 27 bp, Artificial Sequence
  Synthetic Construct
cagggaaccttaatgtagcaatacaga

SEQ ID NO: 28542 - DNA, 23 bp, Artificial Sequence
  Synthetic Construct
ctgagtgtctcaggtggatgctt

SEQ ID NO: 28543 - DNA, 18 bp, Artificial Sequence
  Synthetic Construct
agcacagcctggcacaca

SEQ ID NO: 28544 - DNA, 25 bp, Artificial Sequence
  Synthetic Construct
cagccctggtgaaaaggaacattag

SEQ ID NO: 28545 - DNA, 19 bp, Artificial Sequence
  Synthetic Construct
ggaggctctctgcctgcta

SEQ ID NO: 28546 - DNA, 24 bp, Artificial Sequence
  Synthetic Construct
gtgtccagtgtgctttacacttca

SEQ ID NO: 28547 - DNA, 30 bp, Artificial Sequence
  Synthetic Construct
gtgtgctgaacattgtacttgctcatgtta

SEQ ID NO: 28548 - DNA, 23 bp, Artificial Sequence
  Synthetic Construct
gaccttaaatgccctggacttct

SEQ ID NO: 28549 - DNA, 27 bp, Artificial Sequence
  Synthetic Construct
ctggttgtattgcagtcaaacactcaa

SEQ ID NO: 28550 - DNA, 20 bp, Artificial Sequence
  Synthetic Construct
tgctggtgcacccaagcatt

SEQ ID NO: 28551 - DNA, 23 bp, Artificial Sequence
  Synthetic Construct
aatgacaccaccacccactaaat

SEQ ID NO: 28552 - DNA, 23 bp, Artificial Sequence
  Synthetic Construct
tcacagctgcttcatatgcttga

SEQ ID NO: 28553 - DNA, 26 bp, Artificial Sequence
  Synthetic Construct
ggtatggaactatggagcttgcagtt

SEQ ID NO: 28554 - DNA, 21 bp, Artificial Sequence
  Synthetic Construct
gaacatacaagcgcaggcaat

SEQ ID NO: 28555 - DNA, 24 bp, Artificial Sequence
  Synthetic Construct
tcacctgctttccctcttgaaaaa

SEQ ID NO: 28556 - DNA, 25 bp, Artificial Sequence
  Synthetic Construct
ccagtttcatgtgtttgcctgcttt

SEQ ID NO: 28557 - DNA, 23 bp, Artificial Sequence
  Synthetic Construct
ccagtcctaacctctggctctct

SEQ ID NO: 28558 - DNA, 25 bp, Artificial Sequence
  Synthetic Construct
gttcacagaaatggcttgcctttag

SEQ ID NO: 28559 - DNA, 23 bp, Artificial Sequence
  Synthetic Construct
caggatgacactggagttagctt

SEQ ID NO: 28560 - DNA, 21 bp, Artificial Sequence
  Synthetic Construct
gggtccccagtcagaccatct

SEQ ID NO: 28561 - DNA, 25 bp, Artificial Sequence
  Synthetic Construct
agaggaaacattcaactggaagtga

SEQ ID NO: 28562 - DNA, 24 bp, Artificial Sequence
  Synthetic Construct
gcctgaaggttctttcgtcacttc

SEQ ID NO: 28563 - DNA, 26 bp, Artificial Sequence
  Synthetic Construct
ggcacctgtatcatgttactgctctt

SEQ ID NO: 28564 - DNA, 25 bp, Artificial Sequence
  Synthetic Construct
cctccagaaaacgagaagcaatgat

SEQ ID NO: 28565 - DNA, 25 bp, Artificial Sequence
  Synthetic Construct
gtggagctcactgctttaattgtga

SEQ ID NO: 28566 - DNA, 21 bp, Artificial Sequence
  Synthetic Construct
ggaggctgtccctgtggtttc

SEQ ID NO: 28567 - DNA, 24 bp, Artificial Sequence
  Synthetic Construct
cgcttggttcatacaaaaccaact

SEQ ID NO: 28568 - DNA, 24 bp, Artificial Sequence
  Synthetic Construct
cacgtcccactaggggttaagttc

SEQ ID NO: 28569 - DNA, 25 bp, Artificial Sequence
  Synthetic Construct
gtgtgtttcaagacagcaaggaaag

SEQ ID NO: 28570 - DNA, 24 bp, Artificial Sequence
  Synthetic Construct
cccagttaactcctagagccaaac

SEQ ID NO: 28571 - DNA, 24 bp, Artificial Sequence
  Synthetic Construct
ggcaacatccctcacagctttctt

SEQ ID NO: 28572 - DNA, 23 bp, Artificial Sequence
  Synthetic Construct
gcgtgggatcttgtttgccttga

SEQ ID NO: 28573 - DNA, 24 bp, Artificial Sequence
  Synthetic Construct
gcagttggaaatcgagcagtaaag

SEQ ID NO: 28574 - DNA, 22 bp, Artificial Sequence
  Synthetic Construct
tctcaggagccggtttgttatg

SEQ ID NO: 28575 - DNA, 24 bp, Artificial Sequence
  Synthetic Construct
tgagtgtgtttgtaagtgcaggat

SEQ ID NO: 28576 - DNA, 20 bp, Artificial Sequence
  Synthetic Construct
tgcccacacattcagctgtt

SEQ ID NO: 28577 - DNA, 20 bp, Artificial Sequence
  Synthetic Construct
acaccagtgaggaggccata

SEQ ID NO: 28578 - DNA, 29 bp, Artificial Sequence
  Synthetic Construct
ggtctgagatgtttacttggtttcccaaa

SEQ ID NO: 28579 - DNA, 20 bp, Artificial Sequence
  Synthetic Construct
aactgccgggactgtaccat

SEQ ID NO: 28580 - DNA, 24 bp, Artificial Sequence
  Synthetic Construct
ggagaccaaatgcctttcctcctt

SEQ ID NO: 28581 - DNA, 23 bp, Artificial Sequence
  Synthetic Construct
gagtgagcacagacaaagcaagt

SEQ ID NO: 28582 - DNA, 20 bp, Artificial Sequence
  Synthetic Construct
tctggggctgtcgggtgtct

SEQ ID NO: 28583 - DNA, 22 bp, Artificial Sequence
  Synthetic Construct
gggtgcattgcattgtctcttc

SEQ ID NO: 28584 - DNA, 26 bp, Artificial Sequence
  Synthetic Construct
tgtgttctctctacctagcacaaatg

SEQ ID NO: 28585 - DNA, 22 bp, Artificial Sequence
  Synthetic Construct
ccccagctgccagcctttattt

SEQ ID NO: 28586 - DNA, 23 bp, Artificial Sequence
  Synthetic Construct
ctgtttcctgccgaggttcaact

SEQ ID NO: 28587 - DNA, 20 bp, Artificial Sequence
  Synthetic Construct
agcccaccaaacccctaaga

SEQ ID NO: 28588 - DNA, 19 bp, Artificial Sequence
  Synthetic Construct
gcctgagtgacctgtgcat

SEQ ID NO: 28589 - DNA, 29 bp, Artificial Sequence
  Synthetic Construct
gggaagggttacaaatatgtctacagaag

SEQ ID NO: 28590 - DNA, 27 bp, Artificial Sequence
  Synthetic Construct
gggctagtaagacagattcaggagaag

SEQ ID NO: 28591 - DNA, 25 bp, Artificial Sequence
  Synthetic Construct
ccctaaactgttttcccactctact

SEQ ID NO: 28592 - DNA, 25 bp, Artificial Sequence
  Synthetic Construct
aagtcccattgcatgatagttgaga

SEQ ID NO: 28593 - DNA, 22 bp, Artificial Sequence
  Synthetic Construct
gctccactgcacctggttagtt

SEQ ID NO: 28594 - DNA, 22 bp, Artificial Sequence
  Synthetic Construct
gtgaaactggcatgtccagaga

SEQ ID NO: 28595 - DNA, 23 bp, Artificial Sequence
  Synthetic Construct
tgagcagtttcaaagtcgtgtca

SEQ ID NO: 28596 - DNA, 22 bp, Artificial Sequence
  Synthetic Construct
ggaagcatcccaagcttcttga

SEQ ID NO: 28597 - DNA, 22 bp, Artificial Sequence
  Synthetic Construct
ccctccttcatcagccagaatc

SEQ ID NO: 28598 - DNA, 24 bp, Artificial Sequence
  Synthetic Construct
ggagggaaaagattcagctgtgtt

SEQ ID NO: 28599 - DNA, 25 bp, Artificial Sequence
  Synthetic Construct
ctgaaaaccatcgtgcacaaaattc

SEQ ID NO: 28600 - DNA, 20 bp, Artificial Sequence
  Synthetic Construct
ctgccttgctctgcatctct

SEQ ID NO: 28601 - DNA, 24 bp, Artificial Sequence
  Synthetic Construct
cttccagaaagtaggcacagtttg

SEQ ID NO: 28602 - DNA, 23 bp, Artificial Sequence
  Synthetic Construct
ctgttgatcccctttgcacatct

SEQ ID NO: 28603 - DNA, 24 bp, Artificial Sequence
  Synthetic Construct
cactggaaaccatgccatgcataa

SEQ ID NO: 28604 - DNA, 26 bp, Artificial Sequence
  Synthetic Construct
ccctgtagttgaagctgccataactt

SEQ ID NO: 28605 - DNA, 27 bp, Artificial Sequence
  Synthetic Construct
cctctcctcattttgctagagaaggta

SEQ ID NO: 28606 - DNA, 26 bp, Artificial Sequence
  Synthetic Construct
ctgcaactgcttttctccacaactac

SEQ ID NO: 28607 - DNA, 25 bp, Artificial Sequence
  Synthetic Construct
ctcttttgcacaagcctttcctttg

SEQ ID NO: 28608 - DNA, 27 bp, Artificial Sequence
  Synthetic Construct
ccagatcggtaatacctggaaatggta

SEQ ID NO: 28609 - DNA, 21 bp, Artificial Sequence
  Synthetic Construct
caagcacttgtggctgtctga

SEQ ID NO: 28610 - DNA, 23 bp, Artificial Sequence
  Synthetic Construct
ggacggaacaacacactgggatt

SEQ ID NO: 28611 - DNA, 21 bp, Artificial Sequence
  Synthetic Construct
cgtgcacacgactttttggaa

SEQ ID NO: 28612 - DNA, 21 bp, Artificial Sequence
  Synthetic Construct
agtgagcaggaccttgcaaat

SEQ ID NO: 28613 - DNA, 24 bp, Artificial Sequence
  Synthetic Construct
gagctgtgggaattccatctctca

SEQ ID NO: 28614 - DNA, 21 bp, Artificial Sequence
  Synthetic Construct
gccccttgcatggtgtggtta

SEQ ID NO: 28615 - DNA, 25 bp, Artificial Sequence
  Synthetic Construct
gatgcagggatgtttaactccaatc

SEQ ID NO: 28616 - DNA, 24 bp, Artificial Sequence
  Synthetic Construct
gggttctgtaatcagggccataca

SEQ ID NO: 28617 - DNA, 22 bp, Artificial Sequence
  Synthetic Construct
gggttttggggttcaccacatt

SEQ ID NO: 28618 - DNA, 20 bp, Artificial Sequence
  Synthetic Construct
gcagctgccaagcagatgtt

SEQ ID NO: 28619 - DNA, 27 bp, Artificial Sequence
  Synthetic Construct
cacattaaccttccactggtgccatta

SEQ ID NO: 28620 - DNA, 27 bp, Artificial Sequence
  Synthetic Construct
caattttgggtggagttagagagaaca

SEQ ID NO: 28621 - DNA, 25 bp, Artificial Sequence
  Synthetic Construct
tcctgtgaccctattatctcccatt

SEQ ID NO: 28622 - DNA, 24 bp, Artificial Sequence
  Synthetic Construct
caaggtctgctctcagaagaaact

SEQ ID NO: 28623 - DNA, 22 bp, Artificial Sequence
  Synthetic Construct
ctgtctgcatttggctccttgt

SEQ ID NO: 28624 - DNA, 24 bp, Artificial Sequence
  Synthetic Construct
ggtgagttggaagcacatgtggaa

SEQ ID NO: 28625 - DNA, 22 bp, Artificial Sequence
  Synthetic Construct
ggcctgggcattaggtagcatt

SEQ ID NO: 28626 - DNA, 24 bp, Artificial Sequence
  Synthetic Construct
ccatcaagaggtacaggggtcttc

SEQ ID NO: 28627 - DNA, 21 bp, Artificial Sequence
  Synthetic Construct
ggccctttgggttcagagctt

SEQ ID NO: 28628 - DNA, 23 bp, Artificial Sequence
  Synthetic Construct
cagcctcttcccctttacctttg

SEQ ID NO: 28629 - DNA, 25 bp, Artificial Sequence
  Synthetic Construct
agtacctgccaatgtctatcagtct

SEQ ID NO: 28630 - DNA, 24 bp, Artificial Sequence
  Synthetic Construct
aatcacctgtggcacttgtttaag

SEQ ID NO: 28631 - DNA, 25 bp, Artificial Sequence
  Synthetic Construct
gctaatagctggcatctaggggaaa

SEQ ID NO: 28632 - DNA, 24 bp, Artificial Sequence
  Synthetic Construct
gcagatgcatcctcagagcattac

SEQ ID NO: 28633 - DNA, 25 bp, Artificial Sequence
  Synthetic Construct
aactctgatggagtgatttgcctta

SEQ ID NO: 28634 - DNA, 26 bp, Artificial Sequence
  Synthetic Construct
gctgctgatcacaacagaatgaaaac

SEQ ID NO: 28635 - DNA, 22 bp, Artificial Sequence
  Synthetic Construct
gctctttggactctgccatttc

SEQ ID NO: 28636 - DNA, 25 bp, Artificial Sequence
  Synthetic Construct
actgtggtttttactggaggaaagt

SEQ ID NO: 28637 - DNA, 24 bp, Artificial Sequence
  Synthetic Construct
ggggactgagggacttacttcaac

SEQ ID NO: 28638 - DNA, 23 bp, Artificial Sequence
  Synthetic Construct
caaggatgctgagtccaggttca

SEQ ID NO: 28639 - DNA, 25 bp, Artificial Sequence
  Synthetic Construct
ggcagaaagaaaacccttcgagatg

SEQ ID NO: 28640 - DNA, 19 bp, Artificial Sequence
  Synthetic Construct
agcagtgagcagcctcctt

SEQ ID NO: 28641 - DNA, 21 bp, Artificial Sequence
  Synthetic Construct
gccacaaagccaagtgcaaag

SEQ ID NO: 28642 - DNA, 20 bp, Artificial Sequence
  Synthetic Construct
gaagccctgcagctttctgt

SEQ ID NO: 28643 - DNA, 27 bp, Artificial Sequence
  Synthetic Construct
ccttcagcccaagagaagaatttatca

SEQ ID NO: 28644 - DNA, 24 bp, Artificial Sequence
  Synthetic Construct
gctgtgtggggtacagtagacact

SEQ ID NO: 28645 - DNA, 26 bp, Artificial Sequence
  Synthetic Construct
gacttggactagagacatggaatctt

SEQ ID NO: 28646 - DNA, 28 bp, Artificial Sequence
  Synthetic Construct
ggggatggttcagtaatacctactctgt

SEQ ID NO: 28647 - DNA, 22 bp, Artificial Sequence
  Synthetic Construct
cacactgatggagacccagagt

SEQ ID NO: 28648 - DNA, 26 bp, Artificial Sequence
  Synthetic Construct
ccaagtaactgctgcaagaaaacaca

SEQ ID NO: 28649 - DNA, 29 bp, Artificial Sequence
  Synthetic Construct
ggatctcataaaacgtaactcctctgaca

SEQ ID NO: 28650 - DNA, 30 bp, Artificial Sequence
  Synthetic Construct
gcaccatatttagagggtatcgatttctga

SEQ ID NO: 28651 - DNA, 27 bp, Artificial Sequence
  Synthetic Construct
cagtgcatctagctatcaagtcccaaa

SEQ ID NO: 28652 - DNA, 25 bp, Artificial Sequence
  Synthetic Construct
caagagaggaaaagctctactggaa

SEQ ID NO: 28653 - DNA, 24 bp, Artificial Sequence
  Synthetic Construct
ccatgcctggcctagaaaatgtta

SEQ ID NO: 28654 - DNA, 20 bp, Artificial Sequence
  Synthetic Construct
acctgctgggaacaggatga

SEQ ID NO: 28655 - DNA, 24 bp, Artificial Sequence
  Synthetic Construct
gactgcgtcaatcctcctcctatc

SEQ ID NO: 28656 - DNA, 22 bp, Artificial Sequence
  Synthetic Construct
tcctacttgggctactgcaaag

SEQ ID NO: 28657 - DNA, 19 bp, Artificial Sequence
  Synthetic Construct
agcctccacccttgtccat

SEQ ID NO: 28658 - DNA, 22 bp, Artificial Sequence
  Synthetic Construct
gctggtaggtcactgtgcatgt

SEQ ID NO: 28659 - DNA, 24 bp, Artificial Sequence
  Synthetic Construct
ggaaatcacctcgctaggaacttg

SEQ ID NO: 28660 - DNA, 24 bp, Artificial Sequence
  Synthetic Construct
ggccatccctaaccttgacctatg

SEQ ID NO: 28661 - DNA, 24 bp, Artificial Sequence
  Synthetic Construct
caaagtttgtgcaaagagggaaga

SEQ ID NO: 28662 - DNA, 21 bp, Artificial Sequence
  Synthetic Construct
cgctccagtcaatggcaatgt

SEQ ID NO: 28663 - DNA, 25 bp, Artificial Sequence
  Synthetic Construct
accaaaaggtccttgaatgtagtga

SEQ ID NO: 28664 - DNA, 23 bp, Artificial Sequence
  Synthetic Construct
ctgcatgactggaagagccaaac

SEQ ID NO: 28665 - DNA, 20 bp, Artificial Sequence
  Synthetic Construct
ggtcctgcacactggcaata

SEQ ID NO: 28666 - DNA, 25 bp, Artificial Sequence
  Synthetic Construct
gaaaccacacaaagcaagaggaatc

SEQ ID NO: 28667 - DNA, 24 bp, Artificial Sequence
  Synthetic Construct
ggaggtgagactcagagacataca

SEQ ID NO: 28668 - DNA, 20 bp, Artificial Sequence
  Synthetic Construct
gccagccacagtgtaacaga

SEQ ID NO: 28669 - DNA, 24 bp, Artificial Sequence
  Synthetic Construct
acttcctttacctgatccctctca

SEQ ID NO: 28670 - DNA, 22 bp, Artificial Sequence
  Synthetic Construct
ggcgcgcaaacttgagttactt

SEQ ID NO: 28671 - DNA, 29 bp, Artificial Sequence
  Synthetic Construct
gagaaaccctgagttagaggagatgaaaa

SEQ ID NO: 28672 - DNA, 25 bp, Artificial Sequence
  Synthetic Construct
tgaaacccttacacctgagttcttg

SEQ ID NO: 28673 - DNA, 26 bp, Artificial Sequence
  Synthetic Construct
ggcaggtcattgaaggaaatgaatgt

SEQ ID NO: 28674 - DNA, 22 bp, Artificial Sequence
  Synthetic Construct
ccacagcaccttccttgtgtat

SEQ ID NO: 28675 - DNA, 22 bp, Artificial Sequence
  Synthetic Construct
ctacagccggtttctctgaaca

SEQ ID NO: 28676 - DNA, 20 bp, Artificial Sequence
  Synthetic Construct
cggacaggggagacctcagt

SEQ ID NO: 28677 - DNA, 24 bp, Artificial Sequence
  Synthetic Construct
tctctgtgcttcatgctgtgtaaa

SEQ ID NO: 28678 - DNA, 22 bp, Artificial Sequence
  Synthetic Construct
cccagtgcacagccatatccat

SEQ ID NO: 28679 - DNA, 22 bp, Artificial Sequence
  Synthetic Construct
ccaagcctcagcaatggtggat

SEQ ID NO: 28680 - DNA, 26 bp, Artificial Sequence
  Synthetic Construct
gactaagcctgtatctaccaccactt

SEQ ID NO: 28681 - DNA, 23 bp, Artificial Sequence
  Synthetic Construct
ccagtcttgcctctccaaaccta

SEQ ID NO: 28682 - DNA, 22 bp, Artificial Sequence
  Synthetic Construct
cgcccatgaaaacacagccaat

SEQ ID NO: 28683 - DNA, 23 bp, Artificial Sequence
  Synthetic Construct
cagcctttcttcagctcctccaa

SEQ ID NO: 28684 - DNA, 24 bp, Artificial Sequence
  Synthetic Construct
agattcccattgcctttcttggat

SEQ ID NO: 28685 - DNA, 23 bp, Artificial Sequence
  Synthetic Construct
cagacacagtcacccacgaagat

SEQ ID NO: 28686 - DNA, 22 bp, Artificial Sequence
  Synthetic Construct
ggcttccaccagcttagccaaa

SEQ ID NO: 28687 - DNA, 25 bp, Artificial Sequence
  Synthetic Construct
gtttttgcagagacacccagttttc

SEQ ID NO: 28688 - DNA, 22 bp, Artificial Sequence
  Synthetic Construct
cgtggtgtggacaatgggtatg

SEQ ID NO: 28689 - DNA, 23 bp, Artificial Sequence
  Synthetic Construct
gaggtagaagacccaggaacaag

SEQ ID NO: 28690 - DNA, 20 bp, Artificial Sequence
  Synthetic Construct
aggcagcctagccctaaagt

SEQ ID NO: 28691 - DNA, 26 bp, Artificial Sequence
  Synthetic Construct
gagtcagcctatgcagctattgaatc

SEQ ID NO: 28692 - DNA, 23 bp, Artificial Sequence
  Synthetic Construct
gctcaggcagtgttttgttggat

SEQ ID NO: 28693 - DNA, 22 bp, Artificial Sequence
  Synthetic Construct
tgaacaccactgtgaggacttc

SEQ ID NO: 28694 - DNA, 25 bp, Artificial Sequence
  Synthetic Construct
tgtttttcaaggctacagggtttct

SEQ ID NO: 28695 - DNA, 27 bp, Artificial Sequence
  Synthetic Construct
actgtagctaatctagctctgtctctt

SEQ ID NO: 28696 - DNA, 24 bp, Artificial Sequence
  Synthetic Construct
cagagaccttccttcctggagtag

SEQ ID NO: 28697 - DNA, 23 bp, Artificial Sequence
  Synthetic Construct
ggggctgttagagattggtgaac

SEQ ID NO: 28698 - DNA, 20 bp, Artificial Sequence
  Synthetic Construct
gggcagagatggcacctgtt

SEQ ID NO: 28699 - DNA, 23 bp, Artificial Sequence
  Synthetic Construct
ggggcaattgtgaaacagtggat

SEQ ID NO: 28700 - DNA, 23 bp, Artificial Sequence
  Synthetic Construct
cacaggcttcaggtgaaaagaag

SEQ ID NO: 28701 - DNA, 25 bp, Artificial Sequence
  Synthetic Construct
ggggacaaactttcctagtcagctt

SEQ ID NO: 28702 - DNA, 22 bp, Artificial Sequence
  Synthetic Construct
ccccatgttccatagggcaaac

SEQ ID NO: 28703 - DNA, 26 bp, Artificial Sequence
  Synthetic Construct
gatgttcctcttctgtagggtgaaag

SEQ ID NO: 28704 - DNA, 25 bp, Artificial Sequence
  Synthetic Construct
gtaccaatgtgcaggtatgagtaca

SEQ ID NO: 28705 - DNA, 22 bp, Artificial Sequence
  Synthetic Construct
ctggcagagggacttctgcatt

SEQ ID NO: 28706 - DNA, 21 bp, Artificial Sequence
  Synthetic Construct
ggagcggctcatctcccaaat

SEQ ID NO: 28707 - DNA, 23 bp, Artificial Sequence
  Synthetic Construct
gcagagctgcctaagagaagaaa

SEQ ID NO: 28708 - DNA, 24 bp, Artificial Sequence
  Synthetic Construct
gggagtggtccacatattgtcctt

SEQ ID NO: 28709 - DNA, 25 bp, Artificial Sequence
  Synthetic Construct
gcccttaaaacctccatcccagttc

SEQ ID NO: 28710 - DNA, 22 bp, Artificial Sequence
  Synthetic Construct
acccaagtccatctgcacaaag

SEQ ID NO: 28711 - DNA, 24 bp, Artificial Sequence
  Synthetic Construct
tcctgggacttaaaagcttgactt

SEQ ID NO: 28712 - DNA, 23 bp, Artificial Sequence
  Synthetic Construct
ccgctgataacccattcctggtt

SEQ ID NO: 28713 - DNA, 20 bp, Artificial Sequence
  Synthetic Construct
tgtcccctaaggccatctgt

SEQ ID NO: 28714 - DNA, 20 bp, Artificial Sequence
  Synthetic Construct
tcatcccctgtcctgtgtgt

SEQ ID NO: 28715 - DNA, 27 bp, Artificial Sequence
  Synthetic Construct
gagtgaaggactgagttaagtggaaga

SEQ ID NO: 28716 - DNA, 21 bp, Artificial Sequence
  Synthetic Construct
ggcacagcactagttcacctt

SEQ ID NO: 28717 - DNA, 24 bp, Artificial Sequence
  Synthetic Construct
cccggctttgtcagagtagagaca

SEQ ID NO: 28718 - DNA, 24 bp, Artificial Sequence
  Synthetic Construct
tttctctggccctgtttactttga

SEQ ID NO: 28719 - DNA, 20 bp, Artificial Sequence
  Synthetic Construct
ccaagtcctgcctcttgctt

SEQ ID NO: 28720 - DNA, 22 bp, Artificial Sequence
  Synthetic Construct
gagggtcagcaccaacccataa

SEQ ID NO: 28721 - DNA, 20 bp, Artificial Sequence
  Synthetic Construct
gccagtgccttttgccttct

SEQ ID NO: 28722 - DNA, 22 bp, Artificial Sequence
  Synthetic Construct
caggggcagaagatggaagact

SEQ ID NO: 28723 - DNA, 29 bp, Artificial Sequence
  Synthetic Construct
gccagaaataggatatactgtcccctaaa

SEQ ID NO: 28724 - DNA, 23 bp, Artificial Sequence
  Synthetic Construct
ccccatgaggactgttacctact

SEQ ID NO: 28725 - DNA, 24 bp, Artificial Sequence
  Synthetic Construct
ccttgactttgccatgaccttttc

SEQ ID NO: 28726 - DNA, 25 bp, Artificial Sequence
  Synthetic Construct
tctctgtctctctcccatcaattct

SEQ ID NO: 28727 - DNA, 23 bp, Artificial Sequence
  Synthetic Construct
gggccggtaatcacagtctgttc

SEQ ID NO: 28728 - DNA, 23 bp, Artificial Sequence
  Synthetic Construct
ctgtacctccacctcctcatact

SEQ ID NO: 28729 - DNA, 27 bp, Artificial Sequence
  Synthetic Construct
tgagaggagagtagagttgcagttaat

SEQ ID NO: 28730 - DNA, 22 bp, Artificial Sequence
  Synthetic Construct
ggtaggtggtacgggacaggtt

SEQ ID NO: 28731 - DNA, 30 bp, Artificial Sequence
  Synthetic Construct
gagaaagggatactggaggaatgattgaag

SEQ ID NO: 28732 - DNA, 25 bp, Artificial Sequence
  Synthetic Construct
ggaatttgaggcagccaagattcaa

SEQ ID NO: 28733 - DNA, 20 bp, Artificial Sequence
  Synthetic Construct
ggcctaggttgccttcaaca

SEQ ID NO: 28734 - DNA, 22 bp, Artificial Sequence
  Synthetic Construct
gaagggatcacccgcatttact

SEQ ID NO: 28735 - DNA, 28 bp, Artificial Sequence
  Synthetic Construct
gccttatcctctttgtctcttgcttgtt

SEQ ID NO: 28736 - DNA, 25 bp, Artificial Sequence
  Synthetic Construct
gcctatagacaccaactctgacttt

SEQ ID NO: 28737 - DNA, 29 bp, Artificial Sequence
  Synthetic Construct
gccatcctctggatctcagaagtaatgtt

SEQ ID NO: 28738 - DNA, 24 bp, Artificial Sequence
  Synthetic Construct
tgggtgatgagaaactgagctttg

SEQ ID NO: 28739 - DNA, 22 bp, Artificial Sequence
  Synthetic Construct
gtgcacagtgaggagagtctgt

SEQ ID NO: 28740 - DNA, 23 bp, Artificial Sequence
  Synthetic Construct
caggataggctgaggcatgattg

SEQ ID NO: 28741 - DNA, 20 bp, Artificial Sequence
  Synthetic Construct
tggaagccccagctgtctaa

SEQ ID NO: 28742 - DNA, 26 bp, Artificial Sequence
  Synthetic Construct
cagctcaaaggttctgaagctcattc

SEQ ID NO: 28743 - DNA, 25 bp, Artificial Sequence
  Synthetic Construct
gttgggactacccaaataggaactt

SEQ ID NO: 28744 - DNA, 22 bp, Artificial Sequence
  Synthetic Construct
gccaggggcctttactcacttt

SEQ ID NO: 28745 - DNA, 24 bp, Artificial Sequence
  Synthetic Construct
gggctttaacacacggaagcagaa

SEQ ID NO: 28746 - DNA, 21 bp, Artificial Sequence
  Synthetic Construct
ttccgtttctcccctctgtct

SEQ ID NO: 28747 - DNA, 24 bp, Artificial Sequence
  Synthetic Construct
gggcttttaacatccttcgggtta

SEQ ID NO: 28748 - DNA, 21 bp, Artificial Sequence
  Synthetic Construct
gcattgcccagtcccactgat

SEQ ID NO: 28749 - DNA, 23 bp, Artificial Sequence
  Synthetic Construct
cggaggaggtgttaggagctaca

SEQ ID NO: 28750 - DNA, 23 bp, Artificial Sequence
  Synthetic Construct
gccacctgtgtagaaggtagaac

SEQ ID NO: 28751 - DNA, 23 bp, Artificial Sequence
  Synthetic Construct
ggggagctgagggaggttagaat

SEQ ID NO: 28752 - DNA, 24 bp, Artificial Sequence
  Synthetic Construct
cagaatcaaacctgcgtgtgacaa

SEQ ID NO: 28753 - DNA, 20 bp, Artificial Sequence
  Synthetic Construct
agctggagtgcttcccaatg

SEQ ID NO: 28754 - DNA, 21 bp, Artificial Sequence
  Synthetic Construct
gctcaggctttcaccttggtt

SEQ ID NO: 28755 - DNA, 24 bp, Artificial Sequence
  Synthetic Construct
gtcacacatctgtgtctcaacctt

SEQ ID NO: 28756 - DNA, 22 bp, Artificial Sequence
  Synthetic Construct
cctcaggctgtcttgctaggat

SEQ ID NO: 28757 - DNA, 22 bp, Artificial Sequence
  Synthetic Construct
cccatgggttgatgcaatctgt

SEQ ID NO: 28758 - DNA, 23 bp, Artificial Sequence
  Synthetic Construct
ctgcaggactctagcagacgata

SEQ ID NO: 28759 - DNA, 23 bp, Artificial Sequence
  Synthetic Construct
cctgtgtacaggctactgtgtga

SEQ ID NO: 28760 - DNA, 23 bp, Artificial Sequence
  Synthetic Construct
gccctgacacttggaaagttgtt

SEQ ID NO: 28761 - DNA, 25 bp, Artificial Sequence
  Synthetic Construct
ccaagtacaagtgcagcagttttgt

SEQ ID NO: 28762 - DNA, 21 bp, Artificial Sequence
  Synthetic Construct
gcgctgacactgacacagact

SEQ ID NO: 28763 - DNA, 24 bp, Artificial Sequence
  Synthetic Construct
agaggcacatttgaccctctttac

SEQ ID NO: 28764 - DNA, 26 bp, Artificial Sequence
  Synthetic Construct
ggtaggcaaactcgtagtgaaataag

SEQ ID NO: 28765 - DNA, 21 bp, Artificial Sequence
  Synthetic Construct
tgagtcaacatcgcaccagtt

SEQ ID NO: 28766 - DNA, 26 bp, Artificial Sequence
  Synthetic Construct
gaggctactattcagaaactggagaa

SEQ ID NO: 28767 - DNA, 22 bp, Artificial Sequence
  Synthetic Construct
aactcctcactcagggcacaag

SEQ ID NO: 28768 - DNA, 24 bp, Artificial Sequence
  Synthetic Construct
tgctctaggagaaattgccaggta

SEQ ID NO: 28769 - DNA, 24 bp, Artificial Sequence
  Synthetic Construct
ggcaggtaaagtaactgggagaca

SEQ ID NO: 28770 - DNA, 23 bp, Artificial Sequence
  Synthetic Construct
cccctgtggtaaagggacttaga

SEQ ID NO: 28771 - DNA, 22 bp, Artificial Sequence
  Synthetic Construct
caagtgtggcctactgatccat

SEQ ID NO: 28772 - DNA, 25 bp, Artificial Sequence
  Synthetic Construct
agacttcctaaagtggaggagttga

SEQ ID NO: 28773 - DNA, 21 bp, Artificial Sequence
  Synthetic Construct
ttttccttggcttggctgact

SEQ ID NO: 28774 - DNA, 22 bp, Artificial Sequence
  Synthetic Construct
gctgggagtggaaaggaaatca

SEQ ID NO: 28775 - DNA, 22 bp, Artificial Sequence
  Synthetic Construct
caggcccttaggcttcctgatt

SEQ ID NO: 28776 - DNA, 22 bp, Artificial Sequence
  Synthetic Construct
ctgcaggacaacttgcctttct

SEQ ID NO: 28777 - DNA, 23 bp, Artificial Sequence
  Synthetic Construct
gcccatatccgacattgaagcat

SEQ ID NO: 28778 - DNA, 27 bp, Artificial Sequence
  Synthetic Construct
gggcttctcaccacagttagaataaaa

SEQ ID NO: 28779 - DNA, 22 bp, Artificial Sequence
  Synthetic Construct
tctcctcccacactctctgttg

SEQ ID NO: 28780 - DNA, 27 bp, Artificial Sequence
  Synthetic Construct
gcgtagaatatgtacccagggctatac

SEQ ID NO: 28781 - DNA, 22 bp, Artificial Sequence
  Synthetic Construct
gaggtaaaagcaggaccagtgt

SEQ ID NO: 28782 - DNA, 22 bp, Artificial Sequence
  Synthetic Construct
acaggaaggacagggtgtctca

SEQ ID NO: 28783 - DNA, 22 bp, Artificial Sequence
  Synthetic Construct
tcagcccctgcaggatagtaac

SEQ ID NO: 28784 - DNA, 30 bp, Artificial Sequence
  Synthetic Construct
gctttgacatcactaaaacgatcctgagtt

SEQ ID NO: 28785 - DNA, 25 bp, Artificial Sequence
  Synthetic Construct
gtcccaattctgcaactaactctgt

SEQ ID NO: 28786 - DNA, 20 bp, Artificial Sequence
  Synthetic Construct
gccactggggccacaaacat

SEQ ID NO: 28787 - DNA, 24 bp, Artificial Sequence
  Synthetic Construct
ctaagctaaggctgactgagacaa

SEQ ID NO: 28788 - DNA, 27 bp, Artificial Sequence
  Synthetic Construct
cacatttgagagtggtaagggtataga

SEQ ID NO: 28789 - DNA, 23 bp, Artificial Sequence
  Synthetic Construct
tgcaattctctggaaaggcagta

SEQ ID NO: 28790 - DNA, 23 bp, Artificial Sequence
  Synthetic Construct
tgcaaaagtcctgtgaaggtaca

SEQ ID NO: 28791 - DNA, 20 bp, Artificial Sequence
  Synthetic Construct
tgttgcatgtgtgggtgtga

SEQ ID NO: 28792 - DNA, 24 bp, Artificial Sequence
  Synthetic Construct
catctaaggctgtaaggaccttgt

SEQ ID NO: 28793 - DNA, 27 bp, Artificial Sequence
  Synthetic Construct
ccttcgaagtacgggaatagttaaaca

SEQ ID NO: 28794 - DNA, 24 bp, Artificial Sequence
  Synthetic Construct
aagcagttatgtatgcctggaact

SEQ ID NO: 28795 - DNA, 24 bp, Artificial Sequence
  Synthetic Construct
cctggaaactggtgcttcgacatc

SEQ ID NO: 28796 - DNA, 26 bp, Artificial Sequence
  Synthetic Construct
tgtgagggaatgaacttgaggaaatc

SEQ ID NO: 28797 - DNA, 26 bp, Artificial Sequence
  Synthetic Construct
ccagtggggaaaaactcagaattcaa

SEQ ID NO: 28798 - DNA, 23 bp, Artificial Sequence
  Synthetic Construct
ctcagtgaactacacacccttgt

SEQ ID NO: 28799 - DNA, 21 bp, Artificial Sequence
  Synthetic Construct
tgccctcagagtgggatcgtt

SEQ ID NO: 28800 - DNA, 25 bp, Artificial Sequence
  Synthetic Construct
gggagagaggatgagatgtgaggaa

SEQ ID NO: 28801 - DNA, 23 bp, Artificial Sequence
  Synthetic Construct
tggaatcatgttcatggggttca

SEQ ID NO: 28802 - DNA, 26 bp, Artificial Sequence
  Synthetic Construct
gaggtgctaaatggatggttgagaga

SEQ ID NO: 28803 - DNA, 25 bp, Artificial Sequence
  Synthetic Construct
tggaaaagccaaaggtgttttgatg

SEQ ID NO: 28804 - DNA, 23 bp, Artificial Sequence
  Synthetic Construct
ggaggctcccatgagcctagaaa

SEQ ID NO: 28805 - DNA, 21 bp, Artificial Sequence
  Synthetic Construct
tgtccccacgtcaggtcaact

SEQ ID NO: 28806 - DNA, 30 bp, Artificial Sequence
  Synthetic Construct
ctgatggtgtcaaatgggctatttttcttc

SEQ ID NO: 28807 - DNA, 26 bp, Artificial Sequence
  Synthetic Construct
caagggaagctgtgtcttagacttac

SEQ ID NO: 28808 - DNA, 27 bp, Artificial Sequence
  Synthetic Construct
gagaaaaggcatctccaaatgtgctaa

SEQ ID NO: 28809 - DNA, 24 bp, Artificial Sequence
  Synthetic Construct
gctgaaataggactctaggcagtt

SEQ ID NO: 28810 - DNA, 25 bp, Artificial Sequence
  Synthetic Construct
ctgctgcctctgaaacagaaagttg

SEQ ID NO: 28811 - DNA, 20 bp, Artificial Sequence
  Synthetic Construct
cctgctgcttcctgctgtta

SEQ ID NO: 28812 - DNA, 24 bp, Artificial Sequence
  Synthetic Construct
ggcagatgctcagaggcattaaca

SEQ ID NO: 28813 - DNA, 25 bp, Artificial Sequence
  Synthetic Construct
gagagcatgaatgtgtcatctgtgt

SEQ ID NO: 28814 - DNA, 26 bp, Artificial Sequence
  Synthetic Construct
gggctatgaatttagctctgcatttg

SEQ ID NO: 28815 - DNA, 22 bp, Artificial Sequence
  Synthetic Construct
ggatgctgggagcaatcagttc

SEQ ID NO: 28816 - DNA, 27 bp, Artificial Sequence
  Synthetic Construct
ctcatccattgattccgttcagtaaag

SEQ ID NO: 28817 - DNA, 30 bp, Artificial Sequence
  Synthetic Construct
ctggtttgtaaatttctgaaggcagtggtt

SEQ ID NO: 28818 - DNA, 27 bp, Artificial Sequence
  Synthetic Construct
ctgctcagatgccataaatgtttgaga

SEQ ID NO: 28819 - DNA, 22 bp, Artificial Sequence
  Synthetic Construct
ctgcagcatggctttccatttc

SEQ ID NO: 28820 - DNA, 30 bp, Artificial Sequence
  Synthetic Construct
ctgatcttacaagtattgctttccctgact

SEQ ID NO: 28821 - DNA, 20 bp, Artificial Sequence
  Synthetic Construct
aagggccgatccggaaactt

SEQ ID NO: 28822 - DNA, 22 bp, Artificial Sequence
  Synthetic Construct
cagcagttgcaaaagcacattc

SEQ ID NO: 28823 - DNA, 20 bp, Artificial Sequence
  Synthetic Construct
aagctggtggtggtcactgt

SEQ ID NO: 28824 - DNA, 23 bp, Artificial Sequence
  Synthetic Construct
gccagtttgtaacagcggctttg

SEQ ID NO: 28825 - DNA, 25 bp, Artificial Sequence
  Synthetic Construct
gcttgtatgttgctctttccgtatg

SEQ ID NO: 28826 - DNA, 25 bp, Artificial Sequence
  Synthetic Construct
gcatgggcatttggaatcaaaagat

SEQ ID NO: 28827 - DNA, 27 bp, Artificial Sequence
  Synthetic Construct
agtaagtagaggagtaatggagtgtga

SEQ ID NO: 28828 - DNA, 25 bp, Artificial Sequence
  Synthetic Construct
actgttgagggaatggttcttttct

SEQ ID NO: 28829 - DNA, 23 bp, Artificial Sequence
  Synthetic Construct
ccacttgtgaggacacagcattc

SEQ ID NO: 28830 - DNA, 26 bp, Artificial Sequence
  Synthetic Construct
gagaaccagagcctgtgtcttcatag

SEQ ID NO: 28831 - DNA, 25 bp, Artificial Sequence
  Synthetic Construct
tggactgggaaaagaagacactaga

SEQ ID NO: 28832 - DNA, 26 bp, Artificial Sequence
  Synthetic Construct
ggaggacaacttgttgtttgtggaat

SEQ ID NO: 28833 - DNA, 22 bp, Artificial Sequence
  Synthetic Construct
gggagccttgtggaccagaaat

SEQ ID NO: 28834 - DNA, 25 bp, Artificial Sequence
  Synthetic Construct
ggcctagagttgcaaccttacgaat

SEQ ID NO: 28835 - DNA, 25 bp, Artificial Sequence
  Synthetic Construct
ctgtctacccaaggatctacccaaa

SEQ ID NO: 28836 - DNA, 22 bp, Artificial Sequence
  Synthetic Construct
ggcgtgctacacatgtccacaa

SEQ ID NO: 28837 - DNA, 25 bp, Artificial Sequence
  Synthetic Construct
cttggttctgtcatcctcagacttc

SEQ ID NO: 28838 - DNA, 23 bp, Artificial Sequence
  Synthetic Construct
ggagctcaatcaaggaccacagt

SEQ ID NO: 28839 - DNA, 23 bp, Artificial Sequence
  Synthetic Construct
gcaatgagatcacgctcttgttt

SEQ ID NO: 28840 - DNA, 20 bp, Artificial Sequence
  Synthetic Construct
cagcagcacgtgaagtcaac

SEQ ID NO: 28841 - DNA, 24 bp, Artificial Sequence
  Synthetic Construct
ctggagctgcatccatacccatac

SEQ ID NO: 28842 - DNA, 27 bp, Artificial Sequence
  Synthetic Construct
ctggagaagggtccttttaaagtgcaa

SEQ ID NO: 28843 - DNA, 19 bp, Artificial Sequence
  Synthetic Construct
gcacgtcaggggacactct

SEQ ID NO: 28844 - DNA, 23 bp, Artificial Sequence
  Synthetic Construct
ggggtcattgaatcatggactgt

SEQ ID NO: 28845 - DNA, 23 bp, Artificial Sequence
  Synthetic Construct
cgcatggagattgtgctgctaac

SEQ ID NO: 28846 - DNA, 21 bp, Artificial Sequence
  Synthetic Construct
aaacccactccaacagccttt

SEQ ID NO: 28847 - DNA, 26 bp, Artificial Sequence
  Synthetic Construct
gagccctgattctgaagacaatgaga

SEQ ID NO: 28848 - DNA, 26 bp, Artificial Sequence
  Synthetic Construct
catagattctcacccagtttggttct

SEQ ID NO: 28849 - DNA, 29 bp, Artificial Sequence
  Synthetic Construct
gagacttatgggaagatggagcagtataa

SEQ ID NO: 28850 - DNA, 24 bp, Artificial Sequence
  Synthetic Construct
tgcaaactaagccagtctagtcaa

SEQ ID NO: 28851 - DNA, 23 bp, Artificial Sequence
  Synthetic Construct
ctgctttagctccaggcattaca

SEQ ID NO: 28852 - DNA, 24 bp, Artificial Sequence
  Synthetic Construct
gctgttctcactgggtaactttct

SEQ ID NO: 28853 - DNA, 22 bp, Artificial Sequence
  Synthetic Construct
ctgggccctaaataggcattca

SEQ ID NO: 28854 - DNA, 24 bp, Artificial Sequence
  Synthetic Construct
ggctgtcaggccctgtatacttga

SEQ ID NO: 28855 - DNA, 19 bp, Artificial Sequence
  Synthetic Construct
agggacacttgggcctctt

SEQ ID NO: 28856 - DNA, 28 bp, Artificial Sequence
  Synthetic Construct
gagtcctcagtgagattaagtccagttg

SEQ ID NO: 28857 - DNA, 24 bp, Artificial Sequence
  Synthetic Construct
gagcacacagatggacaggtatag

SEQ ID NO: 28858 - DNA, 22 bp, Artificial Sequence
  Synthetic Construct
gtccacactaagcttccagcaa

SEQ ID NO: 28859 - DNA, 20 bp, Artificial Sequence
  Synthetic Construct
acaggcgggagctcggatca

SEQ ID NO: 28860 - DNA, 25 bp, Artificial Sequence
  Synthetic Construct
gcagcagaaggataaaaacgcaaat

SEQ ID NO: 28861 - DNA, 25 bp, Artificial Sequence
  Synthetic Construct
ccctgtggaagctaaagtgttggaa

SEQ ID NO: 28862 - DNA, 24 bp, Artificial Sequence
  Synthetic Construct
ggttcacatgcagttgtgagaaac

SEQ ID NO: 28863 - DNA, 24 bp, Artificial Sequence
  Synthetic Construct
tgtctgtggtggcaaagaaataga

SEQ ID NO: 28864 - DNA, 25 bp, Artificial Sequence
  Synthetic Construct
ttatcaaggcccatttcaggtatca

SEQ ID NO: 28865 - DNA, 24 bp, Artificial Sequence
  Synthetic Construct
atcagtgggtcattttgtggtact

SEQ ID NO: 28866 - DNA, 21 bp, Artificial Sequence
  Synthetic Construct
cagaaacaacccaggctcaca

SEQ ID NO: 28867 - DNA, 26 bp, Artificial Sequence
  Synthetic Construct
ggccaataactcagctttgcaagaag

SEQ ID NO: 28868 - DNA, 28 bp, Artificial Sequence
  Synthetic Construct
cacatttcaacaggtgcctcttatcctt

SEQ ID NO: 28869 - DNA, 27 bp, Artificial Sequence
  Synthetic Construct
gcctctttatctagagtcagccagatg

SEQ ID NO: 28870 - DNA, 21 bp, Artificial Sequence
  Synthetic Construct
gggtggcagaagccccataat

SEQ ID NO: 28871 - DNA, 25 bp, Artificial Sequence
  Synthetic Construct
acttttgatctaaactcggcccata

SEQ ID NO: 28872 - DNA, 24 bp, Artificial Sequence
  Synthetic Construct
ctcctgctacggttctttcccttt

SEQ ID NO: 28873 - DNA, 22 bp, Artificial Sequence
  Synthetic Construct
gctggaatggaagccagcttag

SEQ ID NO: 28874 - DNA, 24 bp, Artificial Sequence
  Synthetic Construct
tgagagaatgggagagaagtggtt

SEQ ID NO: 28875 - DNA, 30 bp, Artificial Sequence
  Synthetic Construct
gtcctctccacatgaagtagtaaatagttg

SEQ ID NO: 28876 - DNA, 26 bp, Artificial Sequence
  Synthetic Construct
gccaacagcagatctaatgggatgta

SEQ ID NO: 28877 - DNA, 27 bp, Artificial Sequence
  Synthetic Construct
gtcacatataggctgcccattctctaa

SEQ ID NO: 28878 - DNA, 22 bp, Artificial Sequence
  Synthetic Construct
ctgctacccaggccacatttca

SEQ ID NO: 28879 - DNA, 27 bp, Artificial Sequence
  Synthetic Construct
ccccttcttagcttgatcatctgcttt

SEQ ID NO: 28880 - DNA, 25 bp, Artificial Sequence
  Synthetic Construct
ccagatgtcatgcccaataatgact

SEQ ID NO: 28881 - DNA, 20 bp, Artificial Sequence
  Synthetic Construct
tgaggagagcaggggacttg

SEQ ID NO: 28882 - DNA, 24 bp, Artificial Sequence
  Synthetic Construct
gctggtgtccagttttacatcact

SEQ ID NO: 28883 - DNA, 22 bp, Artificial Sequence
  Synthetic Construct
gcttccctggacttccttcttt

SEQ ID NO: 28884 - DNA, 20 bp, Artificial Sequence
  Synthetic Construct
agagctgggcacaagcaaag

SEQ ID NO: 28885 - DNA, 22 bp, Artificial Sequence
  Synthetic Construct
gactggtgatttggggcttaca

SEQ ID NO: 28886 - DNA, 23 bp, Artificial Sequence
  Synthetic Construct
ggttgtggcagatccactaatca

SEQ ID NO: 28887 - DNA, 28 bp, Artificial Sequence
  Synthetic Construct
gggtatctcacatctaagactcaacatc

SEQ ID NO: 28888 - DNA, 22 bp, Artificial Sequence
  Synthetic Construct
tccctggccctatacaagatgt

SEQ ID NO: 28889 - DNA, 23 bp, Artificial Sequence
  Synthetic Construct
ctgcaagcaggaaaggctattca

SEQ ID NO: 28890 - DNA, 23 bp, Artificial Sequence
  Synthetic Construct
tctgactttcaggagcctacact

SEQ ID NO: 28891 - DNA, 20 bp, Artificial Sequence
  Synthetic Construct
gcagcctgagccaattctga

SEQ ID NO: 28892 - DNA, 21 bp, Artificial Sequence
  Synthetic Construct
ggggtaagagctcctctgcat

SEQ ID NO: 28893 - DNA, 23 bp, Artificial Sequence
  Synthetic Construct
ctaacatccctgccatcttcgta

SEQ ID NO: 28894 - DNA, 22 bp, Artificial Sequence
  Synthetic Construct
ccttggcccacttgtgacattt

SEQ ID NO: 28895 - DNA, 23 bp, Artificial Sequence
  Synthetic Construct
ccttggcccatgatttcttccat

SEQ ID NO: 28896 - DNA, 25 bp, Artificial Sequence
  Synthetic Construct
cccatttatgtcaccctccaaccta

SEQ ID NO: 28897 - DNA, 21 bp, Artificial Sequence
  Synthetic Construct
aggcacaaagcagttcacaca

SEQ ID NO: 28898 - DNA, 26 bp, Artificial Sequence
  Synthetic Construct
gagatttcatgacaatggtcctcagt

SEQ ID NO: 28899 - DNA, 24 bp, Artificial Sequence
  Synthetic Construct
gccaaatacagcaactcctcttca

SEQ ID NO: 28900 - DNA, 25 bp, Artificial Sequence
  Synthetic Construct
ctcccaggattgagcacattcttac

SEQ ID NO: 28901 - DNA, 22 bp, Artificial Sequence
  Synthetic Construct
ggtgtggctgcaactatagaca

SEQ ID NO: 28902 - DNA, 26 bp, Artificial Sequence
  Synthetic Construct
gcagtaagctatgattacaccactgt

SEQ ID NO: 28903 - DNA, 21 bp, Artificial Sequence
  Synthetic Construct
ctgcccatagaccatgcaagt

SEQ ID NO: 28904 - DNA, 25 bp, Artificial Sequence
  Synthetic Construct
gtcaatacagccaaggtcagaaatg

SEQ ID NO: 28905 - DNA, 25 bp, Artificial Sequence
  Synthetic Construct
cagacgaatctggacacacttggaa

SEQ ID NO: 28906 - DNA, 26 bp, Artificial Sequence
  Synthetic Construct
ccatctgtattggaaagtgtggttca

SEQ ID NO: 28907 - DNA, 22 bp, Artificial Sequence
  Synthetic Construct
tgctctcctcacctttcagtgt

SEQ ID NO: 28908 - DNA, 23 bp, Artificial Sequence
  Synthetic Construct
tgggttacacatgggacttcctt

SEQ ID NO: 28909 - DNA, 25 bp, Artificial Sequence
  Synthetic Construct
ctcctgcaccaagatatctgcaaag

SEQ ID NO: 28910 - DNA, 22 bp, Artificial Sequence
  Synthetic Construct
gccacaaagagacatggaggaa

SEQ ID NO: 28911 - DNA, 24 bp, Artificial Sequence
  Synthetic Construct
ccaccttttgtccttgggatacat

SEQ ID NO: 28912 - DNA, 26 bp, Artificial Sequence
  Synthetic Construct
gctctgtgatattgtgctgtcaggta

SEQ ID NO: 28913 - DNA, 26 bp, Artificial Sequence
  Synthetic Construct
ggtgcacagtattagcattagcaagt

SEQ ID NO: 28914 - DNA, 22 bp, Artificial Sequence
  Synthetic Construct
ggaaatgctacggaggctgtgt

SEQ ID NO: 28915 - DNA, 25 bp, Artificial Sequence
  Synthetic Construct
actctttaggtgaggacttctctga

SEQ ID NO: 28916 - DNA, 20 bp, Artificial Sequence
  Synthetic Construct
cgaactttgggctgccttca

SEQ ID NO: 28917 - DNA, 24 bp, Artificial Sequence
  Synthetic Construct
catcaggtgatacggctacattca

SEQ ID NO: 28918 - DNA, 21 bp, Artificial Sequence
  Synthetic Construct
tgacaaatgcctctgcctgtt

SEQ ID NO: 28919 - DNA, 22 bp, Artificial Sequence
  Synthetic Construct
gattggtccaagcctgatctga

SEQ ID NO: 28920 - DNA, 22 bp, Artificial Sequence
  Synthetic Construct
ggcacagctgaaaggcaaaaca

SEQ ID NO: 28921 - DNA, 22 bp, Artificial Sequence
  Synthetic Construct
cccaactctcaccatggcttat

SEQ ID NO: 28922 - DNA, 27 bp, Artificial Sequence
  Synthetic Construct
gccttacaatttctaccctggaaaaga

SEQ ID NO: 28923 - DNA, 25 bp, Artificial Sequence
  Synthetic Construct
ccagggcctattggaaaccctaaac

SEQ ID NO: 28924 - DNA, 26 bp, Artificial Sequence
  Synthetic Construct
cagctttctgcccctttttcttttag

SEQ ID NO: 28925 - DNA, 26 bp, Artificial Sequence
  Synthetic Construct
tccatctccttccatctgtttagact

SEQ ID NO: 28926 - DNA, 22 bp, Artificial Sequence
  Synthetic Construct
accaggtgcacgtaacttgtaa

SEQ ID NO: 28927 - DNA, 22 bp, Artificial Sequence
  Synthetic Construct
acatccacaatggcagttctca

SEQ ID NO: 28928 - DNA, 27 bp, Artificial Sequence
  Synthetic Construct
ccagacagaaggtgttgtcctaaccta

SEQ ID NO: 28929 - DNA, 20 bp, Artificial Sequence
  Synthetic Construct
gggaccagctcctcacatca

SEQ ID NO: 28930 - DNA, 23 bp, Artificial Sequence
  Synthetic Construct
gctgatccctggagacacctgtt

SEQ ID NO: 28931 - DNA, 20 bp, Artificial Sequence
  Synthetic Construct
tcccacacccattccaccaa

SEQ ID NO: 28932 - DNA, 24 bp, Artificial Sequence
  Synthetic Construct
ggcttatggctcaaatccaagcaa

SEQ ID NO: 28933 - DNA, 24 bp, Artificial Sequence
  Synthetic Construct
caagcccagtcctatgtacccatt

SEQ ID NO: 28934 - DNA, 23 bp, Artificial Sequence
  Synthetic Construct
cccttaccatgaacccgtaagaa

SEQ ID NO: 28935 - DNA, 22 bp, Artificial Sequence
  Synthetic Construct
gaccttcagcgtcaggagaaca

SEQ ID NO: 28936 - DNA, 27 bp, Artificial Sequence
  Synthetic Construct
cagacttcagctctttcttctccttca

SEQ ID NO: 28937 - DNA, 24 bp, Artificial Sequence
  Synthetic Construct
ggggatagagccatgctttcattg

SEQ ID NO: 28938 - DNA, 24 bp, Artificial Sequence
  Synthetic Construct
ggacttgcttaaggctgggaataa

SEQ ID NO: 28939 - DNA, 27 bp, Artificial Sequence
  Synthetic Construct
cagttgattgtgagtagcagtcacgta

SEQ ID NO: 28940 - DNA, 22 bp, Artificial Sequence
  Synthetic Construct
gaccaagcgaggcagaaggaaa

SEQ ID NO: 28941 - DNA, 30 bp, Artificial Sequence
  Synthetic Construct
ctgaagtctttcaacagaggagtaagatca

SEQ ID NO: 28942 - DNA, 30 bp, Artificial Sequence
  Synthetic Construct
cttttatgactccattagaggtaggggata

SEQ ID NO: 28943 - DNA, 28 bp, Artificial Sequence
  Synthetic Construct
cctgaactcttggatcatcagtcagata

SEQ ID NO: 28944 - DNA, 25 bp, Artificial Sequence
  Synthetic Construct
aaaagtgtcccatgtgtctcaaaac

SEQ ID NO: 28945 - DNA, 24 bp, Artificial Sequence
  Synthetic Construct
cagtaactctcctctctgctttgt

SEQ ID NO: 28946 - DNA, 24 bp, Artificial Sequence
  Synthetic Construct
aggtacacttccatgccaagaaaa

SEQ ID NO: 28947 - DNA, 26 bp, Artificial Sequence
  Synthetic Construct
ccagctctaacccttacccattcttc

SEQ ID NO: 28948 - DNA, 22 bp, Artificial Sequence
  Synthetic Construct
ggaggctgtggccatgattaac

SEQ ID NO: 28949 - DNA, 21 bp, Artificial Sequence
  Synthetic Construct
tcgctggactagatggctact

SEQ ID NO: 28950 - DNA, 24 bp, Artificial Sequence
  Synthetic Construct
ccttctggtttccacccaaagaag

SEQ ID NO: 28951 - DNA, 22 bp, Artificial Sequence
  Synthetic Construct
gggcccttctggagcttttaac

SEQ ID NO: 28952 - DNA, 20 bp, Artificial Sequence
  Synthetic Construct
acagctccctgtcctgcaaa

SEQ ID NO: 28953 - DNA, 24 bp, Artificial Sequence
  Synthetic Construct
cctgtcccgaatttccctctctct

SEQ ID NO: 28954 - DNA, 20 bp, Artificial Sequence
  Synthetic Construct
gtggttggccaggcaatgaa

SEQ ID NO: 28955 - DNA, 25 bp, Artificial Sequence
  Synthetic Construct
gcctgaaagtgtacatgcctcttct

SEQ ID NO: 28956 - DNA, 25 bp, Artificial Sequence
  Synthetic Construct
gggaacataccacagcattcgctta

SEQ ID NO: 28957 - DNA, 25 bp, Artificial Sequence
  Synthetic Construct
agtcaagatgaggagaatccagttc

SEQ ID NO: 28958 - DNA, 23 bp, Artificial Sequence
  Synthetic Construct
gccactggaaggaccaattctga

SEQ ID NO: 28959 - DNA, 25 bp, Artificial Sequence
  Synthetic Construct
ggctagaaaaggaactccactgctt

SEQ ID NO: 28960 - DNA, 22 bp, Artificial Sequence
  Synthetic Construct
ggcacagagaggttcaatccat

SEQ ID NO: 28961 - DNA, 18 bp, Artificial Sequence
  Synthetic Construct
ttgcagcgccactgcttt

SEQ ID NO: 28962 - DNA, 22 bp, Artificial Sequence
  Synthetic Construct
gtcacccattgttgctgagaga

SEQ ID NO: 28963 - DNA, 22 bp, Artificial Sequence
  Synthetic Construct
ccggtcagttgtggacttttgt

SEQ ID NO: 28964 - DNA, 24 bp, Artificial Sequence
  Synthetic Construct
gaggtcaagaaagacctccatgat

SEQ ID NO: 28965 - DNA, 22 bp, Artificial Sequence
  Synthetic Construct
actcagaccctccctcgtgttt

SEQ ID NO: 28966 - DNA, 22 bp, Artificial Sequence
  Synthetic Construct
gctgccttgtcatccttgtttc

SEQ ID NO: 28967 - DNA, 19 bp, Artificial Sequence
  Synthetic Construct
tgggccttcccctcacact

SEQ ID NO: 28968 - DNA, 21 bp, Artificial Sequence
  Synthetic Construct
tgaaggccccagccacattac

SEQ ID NO: 28969 - DNA, 22 bp, Artificial Sequence
  Synthetic Construct
cgacaccaccactgtcatctgt

SEQ ID NO: 28970 - DNA, 22 bp, Artificial Sequence
  Synthetic Construct
ggcagcaagagtgaatgtgttg

SEQ ID NO: 28971 - DNA, 24 bp, Artificial Sequence
  Synthetic Construct
cccagtaccaccacagaataaact

SEQ ID NO: 28972 - DNA, 22 bp, Artificial Sequence
  Synthetic Construct
cttcactgtgtctcacccttga

SEQ ID NO: 28973 - DNA, 27 bp, Artificial Sequence
  Synthetic Construct
ccagaccaaaatcaaactcaagagcaa

SEQ ID NO: 28974 - DNA, 22 bp, Artificial Sequence
  Synthetic Construct
ggagtgtcctcaaactcccaaa

SEQ ID NO: 28975 - DNA, 24 bp, Artificial Sequence
  Synthetic Construct
ccgcattaggcctagtctctgttc

SEQ ID NO: 28976 - DNA, 23 bp, Artificial Sequence
  Synthetic Construct
gctcttaggtctgggctccctaa

SEQ ID NO: 28977 - DNA, 22 bp, Artificial Sequence
  Synthetic Construct
gcctgcctggaaatctcagtct

SEQ ID NO: 28978 - DNA, 25 bp, Artificial Sequence
  Synthetic Construct
cctgtgtttgctttgacttttcctt

SEQ ID NO: 28979 - DNA, 24 bp, Artificial Sequence
  Synthetic Construct
tcaggaaggtctgctcaatgtaag

SEQ ID NO: 28980 - DNA, 24 bp, Artificial Sequence
  Synthetic Construct
gggatgccaaagtggacatacgaa

SEQ ID NO: 28981 - DNA, 26 bp, Artificial Sequence
  Synthetic Construct
cgtatatctttcccgccataggttga

SEQ ID NO: 28982 - DNA, 25 bp, Artificial Sequence
  Synthetic Construct
cccctttacgcaaatctaccttgta

SEQ ID NO: 28983 - DNA, 22 bp, Artificial Sequence
  Synthetic Construct
tgagtggggctgtcaggaaaac

SEQ ID NO: 28984 - DNA, 23 bp, Artificial Sequence
  Synthetic Construct
ggaagggtgaggggagatactga

SEQ ID NO: 28985 - DNA, 20 bp, Artificial Sequence
  Synthetic Construct
gcagggagtagcagcaagtt

SEQ ID NO: 28986 - DNA, 22 bp, Artificial Sequence
  Synthetic Construct
aggggccactcccgtagataaa

SEQ ID NO: 28987 - DNA, 22 bp, Artificial Sequence
  Synthetic Construct
ggccagctggtctgcaaataac

SEQ ID NO: 28988 - DNA, 24 bp, Artificial Sequence
  Synthetic Construct
ttggaaacttagggaaacccaaca

SEQ ID NO: 28989 - DNA, 21 bp, Artificial Sequence
  Synthetic Construct
ggtcacagcagtcagcacaat

SEQ ID NO: 28990 - DNA, 22 bp, Artificial Sequence
  Synthetic Construct
tgatggggacaatcacctcaca

SEQ ID NO: 28991 - DNA, 23 bp, Artificial Sequence
  Synthetic Construct
catcagcgcaatcaggttgaaag

SEQ ID NO: 28992 - DNA, 22 bp, Artificial Sequence
  Synthetic Construct
gccgatccaagttgccatcctt

SEQ ID NO: 28993 - DNA, 22 bp, Artificial Sequence
  Synthetic Construct
ggggaagacaggtgtctgaatg

SEQ ID NO: 28994 - DNA, 22 bp, Artificial Sequence
  Synthetic Construct
cctcggttgctggttcaggatt

SEQ ID NO: 28995 - DNA, 24 bp, Artificial Sequence
  Synthetic Construct
catgacactgcaggactgaagaag

SEQ ID NO: 28996 - DNA, 25 bp, Artificial Sequence
  Synthetic Construct
ggaggtacacactttcccgaaaaac

SEQ ID NO: 28997 - DNA, 21 bp, Artificial Sequence
  Synthetic Construct
cctgctggcttctgagctctt

SEQ ID NO: 28998 - DNA, 22 bp, Artificial Sequence
  Synthetic Construct
gagcccagtgaagcaggaaatg

SEQ ID NO: 28999 - DNA, 23 bp, Artificial Sequence
  Synthetic Construct
ccagcgctcattgacaattcaaa

SEQ ID NO: 29000 - DNA, 22 bp, Artificial Sequence
  Synthetic Construct
aaaccccttccatccgagaatc

SEQ ID NO: 29001 - DNA, 22 bp, Artificial Sequence
  Synthetic Construct
acccatttccaaggtccaggta

SEQ ID NO: 29002 - DNA, 24 bp, Artificial Sequence
  Synthetic Construct
cctctgcccatttgtaacctccta

SEQ ID NO: 29003 - DNA, 25 bp, Artificial Sequence
  Synthetic Construct
cccaacagaagcaggaggataggat

SEQ ID NO: 29004 - DNA, 20 bp, Artificial Sequence
  Synthetic Construct
tgcagctgcctcctttcgtt

SEQ ID NO: 29005 - DNA, 24 bp, Artificial Sequence
  Synthetic Construct
ctgatggtcacacagctctcatag

SEQ ID NO: 29006 - DNA, 26 bp, Artificial Sequence
  Synthetic Construct
ccaaagcttttgcctttgaagctact

SEQ ID NO: 29007 - DNA, 28 bp, Artificial Sequence
  Synthetic Construct
cccaagacagattgacaagtagcttaac

SEQ ID NO: 29008 - DNA, 19 bp, Artificial Sequence
  Synthetic Construct
gccacgcttctgccgttag

SEQ ID NO: 29009 - DNA, 20 bp, Artificial Sequence
  Synthetic Construct
ggaccagccttggggaaatg

SEQ ID NO: 29010 - DNA, 24 bp, Artificial Sequence
  Synthetic Construct
gatgtacacacccacatgtagcaa

SEQ ID NO: 29011 - DNA, 26 bp, Artificial Sequence
  Synthetic Construct
ctgcgtccaatatgtgtactgcttct

SEQ ID NO: 29012 - DNA, 23 bp, Artificial Sequence
  Synthetic Construct
tcctttgcaactctgagctttgt

SEQ ID NO: 29013 - DNA, 26 bp, Artificial Sequence
  Synthetic Construct
gactggtcaatacttgttgagtggtt

SEQ ID NO: 29014 - DNA, 23 bp, Artificial Sequence
  Synthetic Construct
gcagcttcttccacaaagctaga

SEQ ID NO: 29015 - DNA, 22 bp, Artificial Sequence
  Synthetic Construct
aacattcggtgcagctatggta

SEQ ID NO: 29016 - DNA, 20 bp, Artificial Sequence
  Synthetic Construct
acctcccattgccactcgat

SEQ ID NO: 29017 - DNA, 23 bp, Artificial Sequence
  Synthetic Construct
gactaggaagtgtcctcctctga

SEQ ID NO: 29018 - DNA, 24 bp, Artificial Sequence
  Synthetic Construct
tcttggacaaggcatgttttgatg

SEQ ID NO: 29019 - DNA, 25 bp, Artificial Sequence
  Synthetic Construct
cctgaccacatgccttcatatctca

SEQ ID NO: 29020 - DNA, 27 bp, Artificial Sequence
  Synthetic Construct
gactgtttgttcagcctaagtcctaga

SEQ ID NO: 29021 - DNA, 21 bp, Artificial Sequence
  Synthetic Construct
ggctgacctctctcctgtgtt

SEQ ID NO: 29022 - DNA, 25 bp, Artificial Sequence
  Synthetic Construct
agctcatcaaaattcacctgtgtct

SEQ ID NO: 29023 - DNA, 26 bp, Artificial Sequence
  Synthetic Construct
agtcatgagacctattgctaccctta

SEQ ID NO: 29024 - DNA, 20 bp, Artificial Sequence
  Synthetic Construct
tgcctagcctggagcatgaa

SEQ ID NO: 29025 - DNA, 22 bp, Artificial Sequence
  Synthetic Construct
gcttgggctgtggttttctcta

SEQ ID NO: 29026 - DNA, 23 bp, Artificial Sequence
  Synthetic Construct
ccactcaccacctctcaccagat

SEQ ID NO: 29027 - DNA, 25 bp, Artificial Sequence
  Synthetic Construct
tcacccattatcttggacccttttc

SEQ ID NO: 29028 - DNA, 19 bp, Artificial Sequence
  Synthetic Construct
cgcgttttgccgggagatg

SEQ ID NO: 29029 - DNA, 28 bp, Artificial Sequence
  Synthetic Construct
gggatatgaattgccttcttcccacata

SEQ ID NO: 29030 - DNA, 24 bp, Artificial Sequence
  Synthetic Construct
ggaaacttttgcatgactctcaca

SEQ ID NO: 29031 - DNA, 24 bp, Artificial Sequence
  Synthetic Construct
ggagaagcagtttccaagacatga

SEQ ID NO: 29032 - DNA, 25 bp, Artificial Sequence
  Synthetic Construct
aggaagaggactttgtctttcaact

SEQ ID NO: 29033 - DNA, 25 bp, Artificial Sequence
  Synthetic Construct
gctacaagctctactccactcagat

SEQ ID NO: 29034 - DNA, 24 bp, Artificial Sequence
  Synthetic Construct
ccagaaggccatgtatgctctgaa

SEQ ID NO: 29035 - DNA, 26 bp, Artificial Sequence
  Synthetic Construct
gagggaaaagggaacatttcaggtat

SEQ ID NO: 29036 - DNA, 21 bp, Artificial Sequence
  Synthetic Construct
actcaaggccctgggttcaag

SEQ ID NO: 29037 - DNA, 21 bp, Artificial Sequence
  Synthetic Construct
gcccaaaggcagaccactcta

SEQ ID NO: 29038 - DNA, 24 bp, Artificial Sequence
  Synthetic Construct
ggctgaggttcagagaagagaaaa

SEQ ID NO: 29039 - DNA, 25 bp, Artificial Sequence
  Synthetic Construct
ggtgaagaagacttaggagtgacat

SEQ ID NO: 29040 - DNA, 25 bp, Artificial Sequence
  Synthetic Construct
ctctatctcagctttggaggcaaca

SEQ ID NO: 29041 - DNA, 25 bp, Artificial Sequence
  Synthetic Construct
tgaagccaagtctataaggacgttt

SEQ ID NO: 29042 - DNA, 26 bp, Artificial Sequence
  Synthetic Construct
ccctggtgaatctgttttccatcaaa

SEQ ID NO: 29043 - DNA, 21 bp, Artificial Sequence
  Synthetic Construct
ccccaccagctgtttctgaca

SEQ ID NO: 29044 - DNA, 30 bp, Artificial Sequence
  Synthetic Construct
ctcagaatctgttgggaatgatttctccat

SEQ ID NO: 29045 - DNA, 24 bp, Artificial Sequence
  Synthetic Construct
gtcactcaggaaatgggttgaaca

SEQ ID NO: 29046 - DNA, 22 bp, Artificial Sequence
  Synthetic Construct
ccagcctggtccattcaacagt

SEQ ID NO: 29047 - DNA, 24 bp, Artificial Sequence
  Synthetic Construct
ggaaaaagtcacctggcagttttg

SEQ ID NO: 29048 - DNA, 25 bp, Artificial Sequence
  Synthetic Construct
ggtgggaacagatatttctggtgaa

SEQ ID NO: 29049 - DNA, 27 bp, Artificial Sequence
  Synthetic Construct
cagtaagcactgtaaacacccttccta

SEQ ID NO: 29050 - DNA, 26 bp, Artificial Sequence
  Synthetic Construct
gtagctcctaaacacacaagtaccat

SEQ ID NO: 29051 - DNA, 25 bp, Artificial Sequence
  Synthetic Construct
cctcacaccatagtcctttcctcta

SEQ ID NO: 29052 - DNA, 25 bp, Artificial Sequence
  Synthetic Construct
ttgtggtcccaaacagggtatattt

SEQ ID NO: 29053 - DNA, 23 bp, Artificial Sequence
  Synthetic Construct
cccagccacctcctaatggacta

SEQ ID NO: 29054 - DNA, 25 bp, Artificial Sequence
  Synthetic Construct
gtggaaagtcctcaagccctcttag

SEQ ID NO: 29055 - DNA, 22 bp, Artificial Sequence
  Synthetic Construct
gtgcctagccaaggaatacact

SEQ ID NO: 29056 - DNA, 24 bp, Artificial Sequence
  Synthetic Construct
tcaggaagccatggtttttgagat

SEQ ID NO: 29057 - DNA, 27 bp, Artificial Sequence
  Synthetic Construct
gtgtttaggattcagaaagagctgagt

SEQ ID NO: 29058 - DNA, 25 bp, Artificial Sequence
  Synthetic Construct
ggctgcagagatgatacctgagctt

SEQ ID NO: 29059 - DNA, 24 bp, Artificial Sequence
  Synthetic Construct
ccaggtgagattttccttgtcact

SEQ ID NO: 29060 - DNA, 20 bp, Artificial Sequence
  Synthetic Construct
acttggtgtaggggctgagt

SEQ ID NO: 29061 - DNA, 25 bp, Artificial Sequence
  Synthetic Construct
acaaaaggagaggtaaaccctgttc

SEQ ID NO: 29062 - DNA, 23 bp, Artificial Sequence
  Synthetic Construct
aaccagtatagcctggcaaacaa

SEQ ID NO: 29063 - DNA, 25 bp, Artificial Sequence
  Synthetic Construct
gttaccccatgacagcaaaatcaag

SEQ ID NO: 29064 - DNA, 22 bp, Artificial Sequence
  Synthetic Construct
cgcccagccagacttattctca

SEQ ID NO: 29065 - DNA, 19 bp, Artificial Sequence
  Synthetic Construct
tgctgcctggcttctctct

SEQ ID NO: 29066 - DNA, 25 bp, Artificial Sequence
  Synthetic Construct
cataaacactcctttgcctcagtct

SEQ ID NO: 29067 - DNA, 21 bp, Artificial Sequence
  Synthetic Construct
tggagacatccgcccatatca

SEQ ID NO: 29068 - DNA, 24 bp, Artificial Sequence
  Synthetic Construct
ggttctgaggacctgggttttctt

SEQ ID NO: 29069 - DNA, 24 bp, Artificial Sequence
  Synthetic Construct
caggaggtaaacaccatccctgat

SEQ ID NO: 29070 - DNA, 24 bp, Artificial Sequence
  Synthetic Construct
ggggtgagacccatgagtgacatt

SEQ ID NO: 29071 - DNA, 26 bp, Artificial Sequence
  Synthetic Construct
ccactagtttatcccacctgtgtaac

SEQ ID NO: 29072 - DNA, 23 bp, Artificial Sequence
  Synthetic Construct
acccagacaacagtctcatctgt

SEQ ID NO: 29073 - DNA, 19 bp, Artificial Sequence
  Synthetic Construct
tgcgagtggcagtgcttag

SEQ ID NO: 29074 - DNA, 24 bp, Artificial Sequence
  Synthetic Construct
gcattagtgacagggatccaggaa

SEQ ID NO: 29075 - DNA, 20 bp, Artificial Sequence
  Synthetic Construct
ccgatgcgtgacaggtttga

SEQ ID NO: 29076 - DNA, 27 bp, Artificial Sequence
  Synthetic Construct
gtctagagacaatggttctcactgatg

SEQ ID NO: 29077 - DNA, 23 bp, Artificial Sequence
  Synthetic Construct
ttggatgtgtggtgtgagagaag

SEQ ID NO: 29078 - DNA, 22 bp, Artificial Sequence
  Synthetic Construct
ctgggcctccattgttttgtca

SEQ ID NO: 29079 - DNA, 25 bp, Artificial Sequence
  Synthetic Construct
gtttcatccgtttttccctgtagtt

SEQ ID NO: 29080 - DNA, 22 bp, Artificial Sequence
  Synthetic Construct
tggagggaccgtctttggagtt

SEQ ID NO: 29081 - DNA, 23 bp, Artificial Sequence
  Synthetic Construct
ggactggtctgtgctggtgatac

SEQ ID NO: 29082 - DNA, 27 bp, Artificial Sequence
  Synthetic Construct
gtaagtcgtgaagttaaggtacctagt

SEQ ID NO: 29083 - DNA, 24 bp, Artificial Sequence
  Synthetic Construct
ctggaggaatcgcagacagtttca

SEQ ID NO: 29084 - DNA, 26 bp, Artificial Sequence
  Synthetic Construct
ctcattaaagaggtgaggacaggtaa

SEQ ID NO: 29085 - DNA, 25 bp, Artificial Sequence
  Synthetic Construct
gggtccaactgcttatttcttgttg

SEQ ID NO: 29086 - DNA, 27 bp, Artificial Sequence
  Synthetic Construct
ctcatacatttagggctgtgttgttca

SEQ ID NO: 29087 - DNA, 22 bp, Artificial Sequence
  Synthetic Construct
ctttcttggccttgtgggacta

SEQ ID NO: 29088 - DNA, 23 bp, Artificial Sequence
  Synthetic Construct
gtgctcttcagggagggtgaatc

SEQ ID NO: 29089 - DNA, 21 bp, Artificial Sequence
  Synthetic Construct
aggagactgcagtgggagaaa

SEQ ID NO: 29090 - DNA, 24 bp, Artificial Sequence
  Synthetic Construct
tgttgctgatgggacattgagtat

SEQ ID NO: 29091 - DNA, 23 bp, Artificial Sequence
  Synthetic Construct
ggaggctgaagtcactggttcaa

SEQ ID NO: 29092 - DNA, 21 bp, Artificial Sequence
  Synthetic Construct
ggacgcggtacaacgaacttg

SEQ ID NO: 29093 - DNA, 25 bp, Artificial Sequence
  Synthetic Construct
gaggacttaggtttagggtggaatg

SEQ ID NO: 29094 - DNA, 23 bp, Artificial Sequence
  Synthetic Construct
cccactccttacagctggtcttc

SEQ ID NO: 29095 - DNA, 25 bp, Artificial Sequence
  Synthetic Construct
ccagtcttctatgggtctcccagtt

SEQ ID NO: 29096 - DNA, 22 bp, Artificial Sequence
  Synthetic Construct
ggacaccaccctgtaactctga

SEQ ID NO: 29097 - DNA, 23 bp, Artificial Sequence
  Synthetic Construct
ggggtgatggtaaggaggtttac

SEQ ID NO: 29098 - DNA, 25 bp, Artificial Sequence
  Synthetic Construct
ccccagaaactgcatgtcacattac

SEQ ID NO: 29099 - DNA, 24 bp, Artificial Sequence
  Synthetic Construct
gggctggtttgtttagaggttcaa

SEQ ID NO: 29100 - DNA, 24 bp, Artificial Sequence
  Synthetic Construct
ggagcaaacaggaatcatctggaa

SEQ ID NO: 29101 - DNA, 27 bp, Artificial Sequence
  Synthetic Construct
gaacagtgggattcttcttcacatcaa

SEQ ID NO: 29102 - DNA, 21 bp, Artificial Sequence
  Synthetic Construct
ggagcagagcagttggcttca

SEQ ID NO: 29103 - DNA, 24 bp, Artificial Sequence
  Synthetic Construct
ccttccataggctccagtatccaa

SEQ ID NO: 29104 - DNA, 28 bp, Artificial Sequence
  Synthetic Construct
ctgattagacctcgatggatacagatac

SEQ ID NO: 29105 - DNA, 25 bp, Artificial Sequence
  Synthetic Construct
cccagaatctgagagggagatgaac

SEQ ID NO: 29106 - DNA, 25 bp, Artificial Sequence
  Synthetic Construct
ccatgaaacacccactatacctaca

SEQ ID NO: 29107 - DNA, 24 bp, Artificial Sequence
  Synthetic Construct
gggtggggatcaataagaggaaag

SEQ ID NO: 29108 - DNA, 21 bp, Artificial Sequence
  Synthetic Construct
ctggcacaagcatcactgtca

SEQ ID NO: 29109 - DNA, 24 bp, Artificial Sequence
  Synthetic Construct
cactgcttgtacttggtccctttg

SEQ ID NO: 29110 - DNA, 23 bp, Artificial Sequence
  Synthetic Construct
cgaagattcagtgcgtgcattct

SEQ ID NO: 29111 - DNA, 22 bp, Artificial Sequence
  Synthetic Construct
cagtcctgccttctttctcctt

SEQ ID NO: 29112 - DNA, 20 bp, Artificial Sequence
  Synthetic Construct
gggacaccgctcatttggaa

SEQ ID NO: 29113 - DNA, 19 bp, Artificial Sequence
  Synthetic Construct
tgccagccagactgcctaa

SEQ ID NO: 29114 - DNA, 28 bp, Artificial Sequence
  Synthetic Construct
ccataattcaaatccagcctcaggaatg

SEQ ID NO: 29115 - DNA, 25 bp, Artificial Sequence
  Synthetic Construct
cccatactgatgcagtgctagagat

SEQ ID NO: 29116 - DNA, 30 bp, Artificial Sequence
  Synthetic Construct
cctggtgacacaattgggtaagaatgttag

SEQ ID NO: 29117 - DNA, 21 bp, Artificial Sequence
  Synthetic Construct
agggccaaggctaccagtgaa

SEQ ID NO: 29118 - DNA, 24 bp, Artificial Sequence
  Synthetic Construct
ggggactggaagtcatttctgatg

SEQ ID NO: 29119 - DNA, 20 bp, Artificial Sequence
  Synthetic Construct
ggtgtcaatggtgcctcaca

SEQ ID NO: 29120 - DNA, 26 bp, Artificial Sequence
  Synthetic Construct
ggtaccttcctttgaggattgctaca

SEQ ID NO: 29121 - DNA, 20 bp, Artificial Sequence
  Synthetic Construct
cgtgtttccagcaggtgtgt

SEQ ID NO: 29122 - DNA, 24 bp, Artificial Sequence
  Synthetic Construct
ggggacacaactactgatggatac

SEQ ID NO: 29123 - DNA, 20 bp, Artificial Sequence
  Synthetic Construct
aggtgagaagcagggcaaag

SEQ ID NO: 29124 - DNA, 23 bp, Artificial Sequence
  Synthetic Construct
cccatgcatgcagacactctttc

SEQ ID NO: 29125 - DNA, 25 bp, Artificial Sequence
  Synthetic Construct
ctggagaaagacattgctcccatca

SEQ ID NO: 29126 - DNA, 25 bp, Artificial Sequence
  Synthetic Construct
gacctggacataagaaggaagttct

SEQ ID NO: 29127 - DNA, 26 bp, Artificial Sequence
  Synthetic Construct
ccaacaggaattagaaactccacatc

SEQ ID NO: 29128 - DNA, 22 bp, Artificial Sequence
  Synthetic Construct
gagcatcacagtcccatgttca

SEQ ID NO: 29129 - DNA, 22 bp, Artificial Sequence
  Synthetic Construct
gaccactgacaaatgcgtgaag

SEQ ID NO: 29130 - DNA, 23 bp, Artificial Sequence
  Synthetic Construct
tccggtagtgctccctctgtatg

SEQ ID NO: 29131 - DNA, 20 bp, Artificial Sequence
  Synthetic Construct
gggtgctccaaatgcctgaa

SEQ ID NO: 29132 - DNA, 25 bp, Artificial Sequence
  Synthetic Construct
cctcagctgacattgtgtaatgcta

SEQ ID NO: 29133 - DNA, 20 bp, Artificial Sequence
  Synthetic Construct
ccatgcccggcctgtttgta

SEQ ID NO: 29134 - DNA, 22 bp, Artificial Sequence
  Synthetic Construct
cctttagggagcatcgggaatc

SEQ ID NO: 29135 - DNA, 22 bp, Artificial Sequence
  Synthetic Construct
gcacaagcagcaacatttcctt

SEQ ID NO: 29136 - DNA, 22 bp, Artificial Sequence
  Synthetic Construct
ttgtcataccatgccgttcgta

SEQ ID NO: 29137 - DNA, 24 bp, Artificial Sequence
  Synthetic Construct
gcttggaaaaaggcaacctactct

SEQ ID NO: 29138 - DNA, 25 bp, Artificial Sequence
  Synthetic Construct
ggacagcactgaaggacaaggagta

SEQ ID NO: 29139 - DNA, 26 bp, Artificial Sequence
  Synthetic Construct
tgagatggtcacatcctgttctctaa

SEQ ID NO: 29140 - DNA, 25 bp, Artificial Sequence
  Synthetic Construct
ctcccctgtcaaaacttcctcttga

SEQ ID NO: 29141 - DNA, 26 bp, Artificial Sequence
  Synthetic Construct
gcctgacacctgaatttctaccttgt

SEQ ID NO: 29142 - DNA, 22 bp, Artificial Sequence
  Synthetic Construct
ccttctggccctaacaggttct

SEQ ID NO: 29143 - DNA, 22 bp, Artificial Sequence
  Synthetic Construct
ctgtcaccacaagccaccatca

SEQ ID NO: 29144 - DNA, 26 bp, Artificial Sequence
  Synthetic Construct
cctaggagatgctttaaggatgatgt

SEQ ID NO: 29145 - DNA, 22 bp, Artificial Sequence
  Synthetic Construct
ggctctggacaaggaagacaga

SEQ ID NO: 29146 - DNA, 23 bp, Artificial Sequence
  Synthetic Construct
gaggctctgcagaatgttcctaa

SEQ ID NO: 29147 - DNA, 24 bp, Artificial Sequence
  Synthetic Construct
gcggctgcacaattagagtagaga

SEQ ID NO: 29148 - DNA, 25 bp, Artificial Sequence
  Synthetic Construct
ctcaaaggcccaggtctatctgatg

SEQ ID NO: 29149 - DNA, 27 bp, Artificial Sequence
  Synthetic Construct
tcctctcctcaaacaagggatattttg

SEQ ID NO: 29150 - DNA, 26 bp, Artificial Sequence
  Synthetic Construct
gggagactgcatgtatttctgtctgt

SEQ ID NO: 29151 - DNA, 26 bp, Artificial Sequence
  Synthetic Construct
gtgatgggcctgaatccagtattatg

SEQ ID NO: 29152 - DNA, 21 bp, Artificial Sequence
  Synthetic Construct
aggagcccatacatggggaat

SEQ ID NO: 29153 - DNA, 20 bp, Artificial Sequence
  Synthetic Construct
cctgggcttgtggccatatt

SEQ ID NO: 29154 - DNA, 22 bp, Artificial Sequence
  Synthetic Construct
gcagtgaatcccttgcaaaact

SEQ ID NO: 29155 - DNA, 22 bp, Artificial Sequence
  Synthetic Construct
ctcatctggtccaagcttctgt

SEQ ID NO: 29156 - DNA, 22 bp, Artificial Sequence
  Synthetic Construct
ggcatgtcacacactcctacat

SEQ ID NO: 29157 - DNA, 24 bp, Artificial Sequence
  Synthetic Construct
ggttcaaatcctggctccactatc

SEQ ID NO: 29158 - DNA, 23 bp, Artificial Sequence
  Synthetic Construct
cctcaagggacccaatttgaaga

SEQ ID NO: 29159 - DNA, 21 bp, Artificial Sequence
  Synthetic Construct
tccgttttcagggctgggata

SEQ ID NO: 29160 - DNA, 24 bp, Artificial Sequence
  Synthetic Construct
ggaggcgagagtcctttccttttg

SEQ ID NO: 29161 - DNA, 22 bp, Artificial Sequence
  Synthetic Construct
ccctcctggtgtcttccagaaa

SEQ ID NO: 29162 - DNA, 24 bp, Artificial Sequence
  Synthetic Construct
gactctgctttcacggatgggatt

SEQ ID NO: 29163 - DNA, 22 bp, Artificial Sequence
  Synthetic Construct
aggctgaggactaggctctgat

SEQ ID NO: 29164 - DNA, 25 bp, Artificial Sequence
  Synthetic Construct
tccctggtacacctttacacaaatc

SEQ ID NO: 29165 - DNA, 21 bp, Artificial Sequence
  Synthetic Construct
acagctaggccctgggaagat

SEQ ID NO: 29166 - DNA, 22 bp, Artificial Sequence
  Synthetic Construct
ggaggaggtggtggacacaaat

SEQ ID NO: 29167 - DNA, 21 bp, Artificial Sequence
  Synthetic Construct
tggagctgagacctgctggat

SEQ ID NO: 29168 - DNA, 25 bp, Artificial Sequence
  Synthetic Construct
gaggaaaaacacagggtgagggttt

SEQ ID NO: 29169 - DNA, 20 bp, Artificial Sequence
  Synthetic Construct
gcaggactgcccaccacaag

SEQ ID NO: 29170 - DNA, 19 bp, Artificial Sequence
  Synthetic Construct
tccaggcctccaggacttt

SEQ ID NO: 29171 - DNA, 26 bp, Artificial Sequence
  Synthetic Construct
ggctactcactcaagacctctgtcaa

SEQ ID NO: 29172 - DNA, 22 bp, Artificial Sequence
  Synthetic Construct
gggaacccatttccgtgtgttg

SEQ ID NO: 29173 - DNA, 24 bp, Artificial Sequence
  Synthetic Construct
gcactcagaggaggggtgtgttat

SEQ ID NO: 29174 - DNA, 20 bp, Artificial Sequence
  Synthetic Construct
acatggcaggctccttcact

SEQ ID NO: 29175 - DNA, 30 bp, Artificial Sequence
  Synthetic Construct
gtgtgttagattcttccctgacattgtttc

SEQ ID NO: 29176 - DNA, 21 bp, Artificial Sequence
  Synthetic Construct
agcactggtctggaagtgaga

SEQ ID NO: 29177 - DNA, 21 bp, Artificial Sequence
  Synthetic Construct
gcattatgccaagctgacgtt

SEQ ID NO: 29178 - DNA, 18 bp, Artificial Sequence
  Synthetic Construct
aggcacgcaccaccatga

SEQ ID NO: 29179 - DNA, 25 bp, Artificial Sequence
  Synthetic Construct
caaaatacaccactggccataactt

SEQ ID NO: 29180 - DNA, 20 bp, Artificial Sequence
  Synthetic Construct
gccaccacacccaatctcat

SEQ ID NO: 29181 - DNA, 25 bp, Artificial Sequence
  Synthetic Construct
ggtgacaggttagtgatcgtgtgtt

SEQ ID NO: 29182 - DNA, 21 bp, Artificial Sequence
  Synthetic Construct
gccaagagccaatggcaaaag

SEQ ID NO: 29183 - DNA, 24 bp, Artificial Sequence
  Synthetic Construct
cgctagttcattcaccgccttctt

SEQ ID NO: 29184 - DNA, 21 bp, Artificial Sequence
  Synthetic Construct
tccacaaccccatgctgttac

SEQ ID NO: 29185 - DNA, 27 bp, Artificial Sequence
  Synthetic Construct
ccaaagcaaaagcctaaccttatgaac

SEQ ID NO: 29186 - DNA, 27 bp, Artificial Sequence
  Synthetic Construct
ggattcctttccagtaaccaagacaat

SEQ ID NO: 29187 - DNA, 25 bp, Artificial Sequence
  Synthetic Construct
caagttgtctttattgctgctgctt

SEQ ID NO: 29188 - DNA, 25 bp, Artificial Sequence
  Synthetic Construct
aggttacttacagttggaggcttag

SEQ ID NO: 29189 - DNA, 22 bp, Artificial Sequence
  Synthetic Construct
cgacacacgtccacgaacacaa

SEQ ID NO: 29190 - DNA, 20 bp, Artificial Sequence
  Synthetic Construct
ggcagcagctgtcctgtgta

SEQ ID NO: 29191 - DNA, 22 bp, Artificial Sequence
  Synthetic Construct
gggctgtgcatcttagggtcat

SEQ ID NO: 29192 - DNA, 26 bp, Artificial Sequence
  Synthetic Construct
catgaccactgtgacaaaacaagact

SEQ ID NO: 29193 - DNA, 28 bp, Artificial Sequence
  Synthetic Construct
gtgtgctctaaaagtggtctgtaagtga

SEQ ID NO: 29194 - DNA, 23 bp, Artificial Sequence
  Synthetic Construct
gccccgaaaccctagtcctttct

SEQ ID NO: 29195 - DNA, 22 bp, Artificial Sequence
  Synthetic Construct
caggaccagcaagtgggtttca

SEQ ID NO: 29196 - DNA, 24 bp, Artificial Sequence
  Synthetic Construct
acagcagccttacataacctttca

SEQ ID NO: 29197 - DNA, 27 bp, Artificial Sequence
  Synthetic Construct
ggttacaatatttgcaggaagccaaga

SEQ ID NO: 29198 - DNA, 22 bp, Artificial Sequence
  Synthetic Construct
gccattgccttttgcctcagta

SEQ ID NO: 29199 - DNA, 25 bp, Artificial Sequence
  Synthetic Construct
ctgttcatttggcccttttgtatga

SEQ ID NO: 29200 - DNA, 29 bp, Artificial Sequence
  Synthetic Construct
gcaatatactgagagtgacttgggtgatt

SEQ ID NO: 29201 - DNA, 21 bp, Artificial Sequence
  Synthetic Construct
ggggctgcttcccaggtttat

SEQ ID NO: 29202 - DNA, 25 bp, Artificial Sequence
  Synthetic Construct
gaggtcctctccgtggattaaatag

SEQ ID NO: 29203 - DNA, 25 bp, Artificial Sequence
  Synthetic Construct
gccaaggtctgatcacaaaaattca

SEQ ID NO: 29204 - DNA, 23 bp, Artificial Sequence
  Synthetic Construct
agagctggacctaaaagcaaaca

SEQ ID NO: 29205 - DNA, 22 bp, Artificial Sequence
  Synthetic Construct
gggtctgcatgatatgctggta

SEQ ID NO: 29206 - DNA, 21 bp, Artificial Sequence
  Synthetic Construct
tcacagagactgggtcgatct

SEQ ID NO: 29207 - DNA, 27 bp, Artificial Sequence
  Synthetic Construct
agcagagaacagagtaaatgacctatc

SEQ ID NO: 29208 - DNA, 24 bp, Artificial Sequence
  Synthetic Construct
gatctctgggagttgagttgttga

SEQ ID NO: 29209 - DNA, 20 bp, Artificial Sequence
  Synthetic Construct
accaggtggctgggtgacat

SEQ ID NO: 29210 - DNA, 22 bp, Artificial Sequence
  Synthetic Construct
actgaccccaggagtttcatct

SEQ ID NO: 29211 - DNA, 21 bp, Artificial Sequence
  Synthetic Construct
tggcctgactctcccgatttg

SEQ ID NO: 29212 - DNA, 22 bp, Artificial Sequence
  Synthetic Construct
cctggggctgcatttgttgcta

SEQ ID NO: 29213 - DNA, 25 bp, Artificial Sequence
  Synthetic Construct
cctcactcaggaagaatgtgtcctt

SEQ ID NO: 29214 - DNA, 25 bp, Artificial Sequence
  Synthetic Construct
gaacgtttggtaaggcagacataca

SEQ ID NO: 29215 - DNA, 24 bp, Artificial Sequence
  Synthetic Construct
ggtgggtagccatctaggcttttg

SEQ ID NO: 29216 - DNA, 24 bp, Artificial Sequence
  Synthetic Construct
cccaggaacagtaaagcatcattc

SEQ ID NO: 29217 - DNA, 20 bp, Artificial Sequence
  Synthetic Construct
ttctgggcctgcctttgact

SEQ ID NO: 29218 - DNA, 26 bp, Artificial Sequence
  Synthetic Construct
gcatttcactagagatgtgggcttca

SEQ ID NO: 29219 - DNA, 22 bp, Artificial Sequence
  Synthetic Construct
gcacggtgatcactaggctgtt

SEQ ID NO: 29220 - DNA, 22 bp, Artificial Sequence
  Synthetic Construct
cacaccagtctgcctgagtaca

SEQ ID NO: 29221 - DNA, 24 bp, Artificial Sequence
  Synthetic Construct
ccacagagctaggaaactcgtgaa

SEQ ID NO: 29222 - DNA, 22 bp, Artificial Sequence
  Synthetic Construct
gccttccccagaggaatgttgt

SEQ ID NO: 29223 - DNA, 22 bp, Artificial Sequence
  Synthetic Construct
cgaccagccccatcctgttttt

SEQ ID NO: 29224 - DNA, 20 bp, Artificial Sequence
  Synthetic Construct
tgtaaggcgaggaggacgat

SEQ ID NO: 29225 - DNA, 26 bp, Artificial Sequence
  Synthetic Construct
gcccttaaagattagggtgagcatgt

SEQ ID NO: 29226 - DNA, 24 bp, Artificial Sequence
  Synthetic Construct
cagtcttcctttgctcctaaccaa

SEQ ID NO: 29227 - DNA, 25 bp, Artificial Sequence
  Synthetic Construct
gaaattcccctgacgttctttccaa

SEQ ID NO: 29228 - DNA, 20 bp, Artificial Sequence
  Synthetic Construct
gcttcccgtctccccaacaa

SEQ ID NO: 29229 - DNA, 24 bp, Artificial Sequence
  Synthetic Construct
catgtgtctggacttgtcagatgt

SEQ ID NO: 29230 - DNA, 22 bp, Artificial Sequence
  Synthetic Construct
agcgggtaggccatgatagaga

SEQ ID NO: 29231 - DNA, 24 bp, Artificial Sequence
  Synthetic Construct
ggctgtaaacagaggcatttggta

SEQ ID NO: 29232 - DNA, 28 bp, Artificial Sequence
  Synthetic Construct
ggaaagggtagtattgggattacagaca

SEQ ID NO: 29233 - DNA, 20 bp, Artificial Sequence
  Synthetic Construct
gcaccggtgtaagagcaaac

SEQ ID NO: 29234 - DNA, 19 bp, Artificial Sequence
  Synthetic Construct
tggggaggagccaggatct

SEQ ID NO: 29235 - DNA, 19 bp, Artificial Sequence
  Synthetic Construct
agtcgtgctgtgggacagt

SEQ ID NO: 29236 - DNA, 24 bp, Artificial Sequence
  Synthetic Construct
gctggaagattttctgccttttga

SEQ ID NO: 29237 - DNA, 23 bp, Artificial Sequence
  Synthetic Construct
tctttttccctctctggggatca

SEQ ID NO: 29238 - DNA, 24 bp, Artificial Sequence
  Synthetic Construct
agccttccaaggaaaagaaaggaa

SEQ ID NO: 29239 - DNA, 24 bp, Artificial Sequence
  Synthetic Construct
gctggaacaaagaaagcaggagaa

SEQ ID NO: 29240 - DNA, 22 bp, Artificial Sequence
  Synthetic Construct
gctgggtttccctctagctgtt

SEQ ID NO: 29241 - DNA, 21 bp, Artificial Sequence
  Synthetic Construct
aatagccattgccctgagctt

SEQ ID NO: 29242 - DNA, 22 bp, Artificial Sequence
  Synthetic Construct
tggagctcccagcctggtataa

SEQ ID NO: 29243 - DNA, 19 bp, Artificial Sequence
  Synthetic Construct
gcctgcagctggctctcta

SEQ ID NO: 29244 - DNA, 26 bp, Artificial Sequence
  Synthetic Construct
gcccttagagtatactgggctctttc

SEQ ID NO: 29245 - DNA, 25 bp, Artificial Sequence
  Synthetic Construct
gtcaaagctgcaaaagggagataac

SEQ ID NO: 29246 - DNA, 25 bp, Artificial Sequence
  Synthetic Construct
tgtaaggctttctgggataggagat

SEQ ID NO: 29247 - DNA, 24 bp, Artificial Sequence
  Synthetic Construct
ccaccccaggatgtaaggtactca

SEQ ID NO: 29248 - DNA, 22 bp, Artificial Sequence
  Synthetic Construct
gacgtcaggcatagtgatggat

SEQ ID NO: 29249 - DNA, 22 bp, Artificial Sequence
  Synthetic Construct
gaggccagtgctgatcacctaa

SEQ ID NO: 29250 - DNA, 22 bp, Artificial Sequence
  Synthetic Construct
aggcagacggaatgaactttct

SEQ ID NO: 29251 - DNA, 22 bp, Artificial Sequence
  Synthetic Construct
aggtccccaggagaaaggatct

SEQ ID NO: 29252 - DNA, 22 bp, Artificial Sequence
  Synthetic Construct
gcatgtgccaaggtcctgtaac

SEQ ID NO: 29253 - DNA, 20 bp, Artificial Sequence
  Synthetic Construct
cacagcctgtcggcattcta

SEQ ID NO: 29254 - DNA, 23 bp, Artificial Sequence
  Synthetic Construct
cctacagttgatgccaggtgttg

SEQ ID NO: 29255 - DNA, 24 bp, Artificial Sequence
  Synthetic Construct
ctgtggaagggtatgcctcagaag

SEQ ID NO: 29256 - DNA, 22 bp, Artificial Sequence
  Synthetic Construct
gggtgctttctatgggcaaaag

SEQ ID NO: 29257 - DNA, 27 bp, Artificial Sequence
  Synthetic Construct
caaacgtatcaacctaaagtccagaag

SEQ ID NO: 29258 - DNA, 24 bp, Artificial Sequence
  Synthetic Construct
cagcatagattgaggtggcatttc

SEQ ID NO: 29259 - DNA, 21 bp, Artificial Sequence
  Synthetic Construct
ctcctgagttcctgcttcgtt

SEQ ID NO: 29260 - DNA, 25 bp, Artificial Sequence
  Synthetic Construct
accagctgtctttttggtgtaaact

SEQ ID NO: 29261 - DNA, 22 bp, Artificial Sequence
  Synthetic Construct
aagcaagactgggagagaggta

SEQ ID NO: 29262 - DNA, 22 bp, Artificial Sequence
  Synthetic Construct
ctggctccaccaactcacctat

SEQ ID NO: 29263 - DNA, 23 bp, Artificial Sequence
  Synthetic Construct
ccatttaagtgtgggccttgtgt

SEQ ID NO: 29264 - DNA, 19 bp, Artificial Sequence
  Synthetic Construct
tgggacccttccacaccaa

SEQ ID NO: 29265 - DNA, 28 bp, Artificial Sequence
  Synthetic Construct
caaccaaggttgagaactactgagtttg

SEQ ID NO: 29266 - DNA, 22 bp, Artificial Sequence
  Synthetic Construct
gggaatgggaccttgagtttca

SEQ ID NO: 29267 - DNA, 24 bp, Artificial Sequence
  Synthetic Construct
gggaatccgacgaatggatgaaag

SEQ ID NO: 29268 - DNA, 28 bp, Artificial Sequence
  Synthetic Construct
gcaagtggaaaactaaagctcagagatg

SEQ ID NO: 29269 - DNA, 25 bp, Artificial Sequence
  Synthetic Construct
ccagaatccactcaccagaaaaatg

SEQ ID NO: 29270 - DNA, 23 bp, Artificial Sequence
  Synthetic Construct
ggtcccgttttgtgaaccaatag

SEQ ID NO: 29271 - DNA, 22 bp, Artificial Sequence
  Synthetic Construct
gaccttaagggccaccctaact

SEQ ID NO: 29272 - DNA, 21 bp, Artificial Sequence
  Synthetic Construct
accagagacaggcctggaaca

SEQ ID NO: 29273 - DNA, 27 bp, Artificial Sequence
  Synthetic Construct
gaaggtgaagcaggagcaagtattaag

SEQ ID NO: 29274 - DNA, 24 bp, Artificial Sequence
  Synthetic Construct
gtcaggcggtggaattttctgcta

SEQ ID NO: 29275 - DNA, 22 bp, Artificial Sequence
  Synthetic Construct
agccgctctcagactcaggaat

SEQ ID NO: 29276 - DNA, 24 bp, Artificial Sequence
  Synthetic Construct
gacctttgaacagcctgactgtag

SEQ ID NO: 29277 - DNA, 25 bp, Artificial Sequence
  Synthetic Construct
gcctgcatccttgttaatgttggtt

SEQ ID NO: 29278 - DNA, 24 bp, Artificial Sequence
  Synthetic Construct
ggcctgtttgaactgcaagaaaag

SEQ ID NO: 29279 - DNA, 24 bp, Artificial Sequence
  Synthetic Construct
acctgcaaccaaaaagtcatgaga

SEQ ID NO: 29280 - DNA, 20 bp, Artificial Sequence
  Synthetic Construct
caggctgccttttgcagaca

SEQ ID NO: 29281 - DNA, 22 bp, Artificial Sequence
  Synthetic Construct
ccccagcttgttttcggagaga

SEQ ID NO: 29282 - DNA, 26 bp, Artificial Sequence
  Synthetic Construct
caagagagtggacttcaagacaaaac

SEQ ID NO: 29283 - DNA, 22 bp, Artificial Sequence
  Synthetic Construct
ccacagaatgcccacggtaact

SEQ ID NO: 29284 - DNA, 25 bp, Artificial Sequence
  Synthetic Construct
acactagccattcccaaaggtaaaa

SEQ ID NO: 29285 - DNA, 21 bp, Artificial Sequence
  Synthetic Construct
ccatgctgtgtgtgtctgcat

SEQ ID NO: 29286 - DNA, 25 bp, Artificial Sequence
  Synthetic Construct
gcctcacaccactttctagaacaca

SEQ ID NO: 29287 - DNA, 24 bp, Artificial Sequence
  Synthetic Construct
tccagggaattggggtaaatcaaa

SEQ ID NO: 29288 - DNA, 22 bp, Artificial Sequence
  Synthetic Construct
caccactcctgcccatgaagaa

SEQ ID NO: 29289 - DNA, 18 bp, Artificial Sequence
  Synthetic Construct
ttggggatgctgcgttgt

SEQ ID NO: 29290 - DNA, 27 bp, Artificial Sequence
  Synthetic Construct
ggtgtaacctgagactgggaatacttg

SEQ ID NO: 29291 - DNA, 24 bp, Artificial Sequence
  Synthetic Construct
cgtggggaaccagttgttgcataa

SEQ ID NO: 29292 - DNA, 20 bp, Artificial Sequence
  Synthetic Construct
cccaggctgtgtgctttcaa

SEQ ID NO: 29293 - DNA, 20 bp, Artificial Sequence
  Synthetic Construct
tctggcgatgggaagaccat

SEQ ID NO: 29294 - DNA, 24 bp, Artificial Sequence
  Synthetic Construct
ctcagcctccgagtcctcatctat

SEQ ID NO: 29295 - DNA, 25 bp, Artificial Sequence
  Synthetic Construct
gtggggttgatcatagcatctcctt

SEQ ID NO: 29296 - DNA, 19 bp, Artificial Sequence
  Synthetic Construct
acgagcagagcacctgtga

SEQ ID NO: 29297 - DNA, 23 bp, Artificial Sequence
  Synthetic Construct
accttcactgcagtttgctagtt

SEQ ID NO: 29298 - DNA, 23 bp, Artificial Sequence
  Synthetic Construct
gcatgggccaagacatacacaag

SEQ ID NO: 29299 - DNA, 26 bp, Artificial Sequence
  Synthetic Construct
cccctactactgagaacagaccgttt

SEQ ID NO: 29300 - DNA, 25 bp, Artificial Sequence
  Synthetic Construct
cactactgcatctcagttcctgtca

SEQ ID NO: 29301 - DNA, 23 bp, Artificial Sequence
  Synthetic Construct
ctcagcccatagacttcgtgtgt

SEQ ID NO: 29302 - DNA, 20 bp, Artificial Sequence
  Synthetic Construct
tggtcagagggcagacgaat

SEQ ID NO: 29303 - DNA, 20 bp, Artificial Sequence
  Synthetic Construct
tccagtgtcccaccttggta

SEQ ID NO: 29304 - DNA, 27 bp, Artificial Sequence
  Synthetic Construct
gacagtttgccagtcattatccacttc

SEQ ID NO: 29305 - DNA, 22 bp, Artificial Sequence
  Synthetic Construct
tggagtaggtgagcttgtggat

SEQ ID NO: 29306 - DNA, 26 bp, Artificial Sequence
  Synthetic Construct
catggtctttttccacaggacatttg

SEQ ID NO: 29307 - DNA, 22 bp, Artificial Sequence
  Synthetic Construct
cccttccacttggggcagaata

SEQ ID NO: 29308 - DNA, 25 bp, Artificial Sequence
  Synthetic Construct
gcagagaagggatcagaaagactgt

SEQ ID NO: 29309 - DNA, 25 bp, Artificial Sequence
  Synthetic Construct
gaaggcagtggctgataaagatttg

SEQ ID NO: 29310 - DNA, 24 bp, Artificial Sequence
  Synthetic Construct
gtgctgtggacaaactttccatct

SEQ ID NO: 29311 - DNA, 23 bp, Artificial Sequence
  Synthetic Construct
cccagctccagattctcctgaac

SEQ ID NO: 29312 - DNA, 24 bp, Artificial Sequence
  Synthetic Construct
gtcagtttaacctgcccagaaagt

SEQ ID NO: 29313 - DNA, 27 bp, Artificial Sequence
  Synthetic Construct
gttgtgaaagattggggattgtgacat

SEQ ID NO: 29314 - DNA, 22 bp, Artificial Sequence
  Synthetic Construct
aggatgaaggcagagaggacat

SEQ ID NO: 29315 - DNA, 23 bp, Artificial Sequence
  Synthetic Construct
ggtaccacctcctttctttccaa

SEQ ID NO: 29316 - DNA, 22 bp, Artificial Sequence
  Synthetic Construct
gcatggggcatgtgggaattga

SEQ ID NO: 29317 - DNA, 27 bp, Artificial Sequence
  Synthetic Construct
ccttcccatattgggtcagtgtctgta

SEQ ID NO: 29318 - DNA, 24 bp, Artificial Sequence
  Synthetic Construct
ccagcatccctaccttcgagaaac

SEQ ID NO: 29319 - DNA, 24 bp, Artificial Sequence
  Synthetic Construct
gcaagacaaagtccaccccacttt

SEQ ID NO: 29320 - DNA, 22 bp, Artificial Sequence
  Synthetic Construct
ccccatgtttgcagtggagttc

SEQ ID NO: 29321 - DNA, 25 bp, Artificial Sequence
  Synthetic Construct
cgaggaagctctccatctcattagt

SEQ ID NO: 29322 - DNA, 23 bp, Artificial Sequence
  Synthetic Construct
gcaagcatctgtacttcctccat

SEQ ID NO: 29323 - DNA, 23 bp, Artificial Sequence
  Synthetic Construct
cctgtttctgcatccttggtcat

SEQ ID NO: 29324 - DNA, 22 bp, Artificial Sequence
  Synthetic Construct
ggaccaaggttcagcagcctat

SEQ ID NO: 29325 - DNA, 21 bp, Artificial Sequence
  Synthetic Construct
ggcttgggagcatttgcagtt

SEQ ID NO: 29326 - DNA, 26 bp, Artificial Sequence
  Synthetic Construct
ctgtgattcgtatgactttgggcttt

SEQ ID NO: 29327 - DNA, 20 bp, Artificial Sequence
  Synthetic Construct
gagctgctcaggctgcttta

SEQ ID NO: 29328 - DNA, 24 bp, Artificial Sequence
  Synthetic Construct
ccagctttgattccacactgattt

SEQ ID NO: 29329 - DNA, 22 bp, Artificial Sequence
  Synthetic Construct
gaagcagctgaggttctaccaa

SEQ ID NO: 29330 - DNA, 23 bp, Artificial Sequence
  Synthetic Construct
aagcaaacaccgtatcactctga

SEQ ID NO: 29331 - DNA, 21 bp, Artificial Sequence
  Synthetic Construct
aggagccggtcctcactgtag

SEQ ID NO: 29332 - DNA, 24 bp, Artificial Sequence
  Synthetic Construct
gtggatcccctcttcctgagtcat

SEQ ID NO: 29333 - DNA, 24 bp, Artificial Sequence
  Synthetic Construct
gacctgattgtcctggtggaggta

SEQ ID NO: 29334 - DNA, 24 bp, Artificial Sequence
  Synthetic Construct
ggcccaatcagatgctttggtcat

SEQ ID NO: 29335 - DNA, 25 bp, Artificial Sequence
  Synthetic Construct
cacccttctaccttgccattagtat

SEQ ID NO: 29336 - DNA, 21 bp, Artificial Sequence
  Synthetic Construct
ccaaacagtgtcgggtgttga

SEQ ID NO: 29337 - DNA, 20 bp, Artificial Sequence
  Synthetic Construct
gccaaacgtgctgagtcttg

SEQ ID NO: 29338 - DNA, 22 bp, Artificial Sequence
  Synthetic Construct
ggaaggggaggaaaaagggaaa

SEQ ID NO: 29339 - DNA, 27 bp, Artificial Sequence
  Synthetic Construct
agatacgaggctcgacattttactaag

SEQ ID NO: 29340 - DNA, 22 bp, Artificial Sequence
  Synthetic Construct
cagctggacgcttgattagtct

SEQ ID NO: 29341 - DNA, 19 bp, Artificial Sequence
  Synthetic Construct
caggcagggcgtgatatgt

SEQ ID NO: 29342 - DNA, 20 bp, Artificial Sequence
  Synthetic Construct
ccctgcatcggtggcaaaat

SEQ ID NO: 29343 - DNA, 24 bp, Artificial Sequence
  Synthetic Construct
ggccagctttgagtgttacagaac

SEQ ID NO: 29344 - DNA, 22 bp, Artificial Sequence
  Synthetic Construct
ccagcaaacacaccaaggaagt

SEQ ID NO: 29345 - DNA, 26 bp, Artificial Sequence
  Synthetic Construct
cagggatcaataaggcacttggagta

SEQ ID NO: 29346 - DNA, 26 bp, Artificial Sequence
  Synthetic Construct
gaagaaacagagagcaactgagactt

SEQ ID NO: 29347 - DNA, 22 bp, Artificial Sequence
  Synthetic Construct
tgcccttaaaccatggcagatg

SEQ ID NO: 29348 - DNA, 26 bp, Artificial Sequence
  Synthetic Construct
gagcagtttggaagaagtcctatcat

SEQ ID NO: 29349 - DNA, 27 bp, Artificial Sequence
  Synthetic Construct
gtgaaagatttaccccttatggtccta

SEQ ID NO: 29350 - DNA, 20 bp, Artificial Sequence
  Synthetic Construct
ggctgaggcagtcagagtgt

SEQ ID NO: 29351 - DNA, 23 bp, Artificial Sequence
  Synthetic Construct
gggacctctaggtttcagcttct

SEQ ID NO: 29352 - DNA, 24 bp, Artificial Sequence
  Synthetic Construct
agtgggaacttcagagctagactt

SEQ ID NO: 29353 - DNA, 26 bp, Artificial Sequence
  Synthetic Construct
cgaattccttgtccttgtagcctttc

SEQ ID NO: 29354 - DNA, 30 bp, Artificial Sequence
  Synthetic Construct
ctgagataggtcatctcttgaagacagagt

SEQ ID NO: 29355 - DNA, 23 bp, Artificial Sequence
  Synthetic Construct
gctagcagagctcaggaaagttg

SEQ ID NO: 29356 - DNA, 24 bp, Artificial Sequence
  Synthetic Construct
acacatgactgtagccaattcctt

SEQ ID NO: 29357 - DNA, 25 bp, Artificial Sequence
  Synthetic Construct
tgctcttagaaaccaaaccaactct

SEQ ID NO: 29358 - DNA, 23 bp, Artificial Sequence
  Synthetic Construct
aggagacatgggacaggtatgtt

SEQ ID NO: 29359 - DNA, 25 bp, Artificial Sequence
  Synthetic Construct
ccagggctacacaatagaggtttct

SEQ ID NO: 29360 - DNA, 26 bp, Artificial Sequence
  Synthetic Construct
ggaaggaagagagaagcctcagtatc

SEQ ID NO: 29361 - DNA, 21 bp, Artificial Sequence
  Synthetic Construct
gctgaggacggctgcttgata

SEQ ID NO: 29362 - DNA, 22 bp, Artificial Sequence
  Synthetic Construct
cacatgacccgttctgggtaac

SEQ ID NO: 29363 - DNA, 25 bp, Artificial Sequence
  Synthetic Construct
gacccttgaaggaatgtaggcagta

SEQ ID NO: 29364 - DNA, 23 bp, Artificial Sequence
  Synthetic Construct
gcatacatgcttcactgcacttc

SEQ ID NO: 29365 - DNA, 26 bp, Artificial Sequence
  Synthetic Construct
cccctttgtcattgaggaaagagttt

SEQ ID NO: 29366 - DNA, 23 bp, Artificial Sequence
  Synthetic Construct
gaaggtcactctggcttcattgt

SEQ ID NO: 29367 - DNA, 25 bp, Artificial Sequence
  Synthetic Construct
cctgggttaattcccttcccactct

SEQ ID NO: 29368 - DNA, 26 bp, Artificial Sequence
  Synthetic Construct
cacgttcatcatagcttgtcaacact

SEQ ID NO: 29369 - DNA, 22 bp, Artificial Sequence
  Synthetic Construct
ggttccttcccatggctacact

SEQ ID NO: 29370 - DNA, 25 bp, Artificial Sequence
  Synthetic Construct
gaggagttcccagtaatgcaactat

SEQ ID NO: 29371 - DNA, 30 bp, Artificial Sequence
  Synthetic Construct
ccacttagagtgttgcttttaactcccatt

SEQ ID NO: 29372 - DNA, 26 bp, Artificial Sequence
  Synthetic Construct
gtttacaccctcagtctacacaagaa

SEQ ID NO: 29373 - DNA, 21 bp, Artificial Sequence
  Synthetic Construct
gatttcacggcagaggtgtgt

SEQ ID NO: 29374 - DNA, 27 bp, Artificial Sequence
  Synthetic Construct
actagctggaatggtggtaaagaatac

SEQ ID NO: 29375 - DNA, 24 bp, Artificial Sequence
  Synthetic Construct
tcttctgacagcagtgctactcta

SEQ ID NO: 29376 - DNA, 29 bp, Artificial Sequence
  Synthetic Construct
ccctgagttagttcagtgaaggtgtattg

SEQ ID NO: 29377 - DNA, 24 bp, Artificial Sequence
  Synthetic Construct
caggttactactgctggtgtgctt

SEQ ID NO: 29378 - DNA, 25 bp, Artificial Sequence
  Synthetic Construct
ctggatgaatggctgtacacacaga

SEQ ID NO: 29379 - DNA, 22 bp, Artificial Sequence
  Synthetic Construct
actgctgtttggggataagcat

SEQ ID NO: 29380 - DNA, 24 bp, Artificial Sequence
  Synthetic Construct
gcaaaacatgggtctaagcctgta

SEQ ID NO: 29381 - DNA, 24 bp, Artificial Sequence
  Synthetic Construct
ggctttccaaacacgtctggagtt

SEQ ID NO: 29382 - DNA, 22 bp, Artificial Sequence
  Synthetic Construct
ctccctgcctgtgcctctattt

SEQ ID NO: 29383 - DNA, 27 bp, Artificial Sequence
  Synthetic Construct
ccaatttagtctgtcaaggtccctttc

SEQ ID NO: 29384 - DNA, 24 bp, Artificial Sequence
  Synthetic Construct
gggatggggaagaagggcttacta

SEQ ID NO: 29385 - DNA, 22 bp, Artificial Sequence
  Synthetic Construct
tggacctggaggcagtaacttg

SEQ ID NO: 29386 - DNA, 22 bp, Artificial Sequence
  Synthetic Construct
tgaggctgaacccatcagaaga

SEQ ID NO: 29387 - DNA, 19 bp, Artificial Sequence
  Synthetic Construct
tccagacctcgtgctgctt

SEQ ID NO: 29388 - DNA, 27 bp, Artificial Sequence
  Synthetic Construct
cgttcttcaaaaagcagactggaccaa

SEQ ID NO: 29389 - DNA, 22 bp, Artificial Sequence
  Synthetic Construct
ggttttcaccaatgccccttca

SEQ ID NO: 29390 - DNA, 27 bp, Artificial Sequence
  Synthetic Construct
ctcgcttaagatctcactttgagtaac

SEQ ID NO: 29391 - DNA, 22 bp, Artificial Sequence
  Synthetic Construct
gtctgtgggtgatgaggaccat

SEQ ID NO: 29392 - DNA, 24 bp, Artificial Sequence
  Synthetic Construct
gggagctgggatctgagtaagact

SEQ ID NO: 29393 - DNA, 25 bp, Artificial Sequence
  Synthetic Construct
ggcatttctagacccaccttgtatc

SEQ ID NO: 29394 - DNA, 22 bp, Artificial Sequence
  Synthetic Construct
cgctcccaggaaccaaggtatt

SEQ ID NO: 29395 - DNA, 29 bp, Artificial Sequence
  Synthetic Construct
gtggtaggagtaaggaatttgcagaaaac

SEQ ID NO: 29396 - DNA, 25 bp, Artificial Sequence
  Synthetic Construct
tctagctcatccccaatgttctttc

SEQ ID NO: 29397 - DNA, 22 bp, Artificial Sequence
  Synthetic Construct
cccgggatttgttccctaaaca

SEQ ID NO: 29398 - DNA, 25 bp, Artificial Sequence
  Synthetic Construct
gcctggggtaatgaattctgctgat

SEQ ID NO: 29399 - DNA, 20 bp, Artificial Sequence
  Synthetic Construct
gcctcagaccctggcactca

SEQ ID NO: 29400 - DNA, 24 bp, Artificial Sequence
  Synthetic Construct
cccaaccttaaccaaaggaagcaa

SEQ ID NO: 29401 - DNA, 23 bp, Artificial Sequence
  Synthetic Construct
agcccctcaccggaagtcttatc

SEQ ID NO: 29402 - DNA, 25 bp, Artificial Sequence
  Synthetic Construct
cctaggtggagtcttcattctctca

SEQ ID NO: 29403 - DNA, 25 bp, Artificial Sequence
  Synthetic Construct
gtctgtgaatctcacactcctcaca

SEQ ID NO: 29404 - DNA, 25 bp, Artificial Sequence
  Synthetic Construct
cagttagggctgcttgtcttagtct

SEQ ID NO: 29405 - DNA, 28 bp, Artificial Sequence
  Synthetic Construct
gactctgtcacaatcaagagaaggaatg

SEQ ID NO: 29406 - DNA, 29 bp, Artificial Sequence
  Synthetic Construct
ggctccccaactatcatgtatgtcaaatg

SEQ ID NO: 29407 - DNA, 24 bp, Artificial Sequence
  Synthetic Construct
gactttgcaagccatacagcttct

SEQ ID NO: 29408 - DNA, 22 bp, Artificial Sequence
  Synthetic Construct
gggctcacacaaagctgacttc

SEQ ID NO: 29409 - DNA, 21 bp, Artificial Sequence
  Synthetic Construct
cccctggagctgctaatttga

SEQ ID NO: 29410 - DNA, 27 bp, Artificial Sequence
  Synthetic Construct
ggaaaggagagaaattgaaggcatttg

SEQ ID NO: 29411 - DNA, 25 bp, Artificial Sequence
  Synthetic Construct
tcaactgagattcagagccctaaga

SEQ ID NO: 29412 - DNA, 24 bp, Artificial Sequence
  Synthetic Construct
gcaggagatcccctttacccagtt

SEQ ID NO: 29413 - DNA, 23 bp, Artificial Sequence
  Synthetic Construct
gccaagttccagacaccatcaca

SEQ ID NO: 29414 - DNA, 27 bp, Artificial Sequence
  Synthetic Construct
acatcatggataggctagaggttatga

SEQ ID NO: 29415 - DNA, 21 bp, Artificial Sequence
  Synthetic Construct
acaaggcaggaggagcattac

SEQ ID NO: 29416 - DNA, 21 bp, Artificial Sequence
  Synthetic Construct
gctgctccaagcacagaccta

SEQ ID NO: 29417 - DNA, 22 bp, Artificial Sequence
  Synthetic Construct
cctctccacccttctgtactct

SEQ ID NO: 29418 - DNA, 23 bp, Artificial Sequence
  Synthetic Construct
tggacaaattccaagtgctcaca

SEQ ID NO: 29419 - DNA, 22 bp, Artificial Sequence
  Synthetic Construct
tggagcaggattccggtaggtt

SEQ ID NO: 29420 - DNA, 23 bp, Artificial Sequence
  Synthetic Construct
cccagttcatttcctcgtgttct

SEQ ID NO: 29421 - DNA, 22 bp, Artificial Sequence
  Synthetic Construct
gcatgggtactgacccgtttct

SEQ ID NO: 29422 - DNA, 22 bp, Artificial Sequence
  Synthetic Construct
ccctggaactcgagagatgctt

SEQ ID NO: 29423 - DNA, 23 bp, Artificial Sequence
  Synthetic Construct
ccttggatcctggaactgtgctt

SEQ ID NO: 29424 - DNA, 25 bp, Artificial Sequence
  Synthetic Construct
gaggaaaggattacattccggagaa

SEQ ID NO: 29425 - DNA, 27 bp, Artificial Sequence
  Synthetic Construct
gccaaagataacggattcaaggcaact

SEQ ID NO: 29426 - DNA, 20 bp, Artificial Sequence
  Synthetic Construct
cagggactgggcagaaaaca

SEQ ID NO: 29427 - DNA, 22 bp, Artificial Sequence
  Synthetic Construct
cccagacagctgcggctaataa

SEQ ID NO: 29428 - DNA, 30 bp, Artificial Sequence
  Synthetic Construct
gggtcttcattttctgccgtacctataaac

SEQ ID NO: 29429 - DNA, 26 bp, Artificial Sequence
  Synthetic Construct
cagcacagagttttatcctcctctac

SEQ ID NO: 29430 - DNA, 22 bp, Artificial Sequence
  Synthetic Construct
ccccttactcacctggccaaag

SEQ ID NO: 29431 - DNA, 21 bp, Artificial Sequence
  Synthetic Construct
tgcaccagttcctccgtgaga

SEQ ID NO: 29432 - DNA, 21 bp, Artificial Sequence
  Synthetic Construct
ggagccactggtcagaagaca

SEQ ID NO: 29433 - DNA, 21 bp, Artificial Sequence
  Synthetic Construct
gaaagcagaccctgagaccaa

SEQ ID NO: 29434 - DNA, 24 bp, Artificial Sequence
  Synthetic Construct
acagagatcataggtggcatcctt

SEQ ID NO: 29435 - DNA, 24 bp, Artificial Sequence
  Synthetic Construct
gcttccacctccacattcctgact

SEQ ID NO: 29436 - DNA, 24 bp, Artificial Sequence
  Synthetic Construct
gaataaaatgcatccacgctcact

SEQ ID NO: 29437 - DNA, 21 bp, Artificial Sequence
  Synthetic Construct
aatacgccccagcccttgtca

SEQ ID NO: 29438 - DNA, 23 bp, Artificial Sequence
  Synthetic Construct
ctgtgtaccaagtggatggatga

SEQ ID NO: 29439 - DNA, 25 bp, Artificial Sequence
  Synthetic Construct
gggcaaatttagccacccatgaaag

SEQ ID NO: 29440 - DNA, 20 bp, Artificial Sequence
  Synthetic Construct
gcgtgaatgcgtgggaaaca

SEQ ID NO: 29441 - DNA, 22 bp, Artificial Sequence
  Synthetic Construct
acacagccacataccacacatc

SEQ ID NO: 29442 - DNA, 22 bp, Artificial Sequence
  Synthetic Construct
gggagtcaccagcagagtcata

SEQ ID NO: 29443 - DNA, 24 bp, Artificial Sequence
  Synthetic Construct
ttgcaggatgacagaccaaagtta

SEQ ID NO: 29444 - DNA, 23 bp, Artificial Sequence
  Synthetic Construct
ccgagcctatgctgaggtgtaag

SEQ ID NO: 29445 - DNA, 30 bp, Artificial Sequence
  Synthetic Construct
cagaatcctatatgctaggctcataaccaa

SEQ ID NO: 29446 - DNA, 23 bp, Artificial Sequence
  Synthetic Construct
gggaattctccaaccccatttct

SEQ ID NO: 29447 - DNA, 22 bp, Artificial Sequence
  Synthetic Construct
tggccatagaggctgagagctt

SEQ ID NO: 29448 - DNA, 19 bp, Artificial Sequence
  Synthetic Construct
tcccagtgcccacttcact

SEQ ID NO: 29449 - DNA, 25 bp, Artificial Sequence
  Synthetic Construct
ggctgattatcggcagaatttggtt

SEQ ID NO: 29450 - DNA, 24 bp, Artificial Sequence
  Synthetic Construct
ccacactaggaatgtgggacacaa

SEQ ID NO: 29451 - DNA, 26 bp, Artificial Sequence
  Synthetic Construct
tcatatttctccatcccagctgttac

SEQ ID NO: 29452 - DNA, 26 bp, Artificial Sequence
  Synthetic Construct
gctagatgatgatgtcctctaccaaa

SEQ ID NO: 29453 - DNA, 22 bp, Artificial Sequence
  Synthetic Construct
catccagcgtcacattctgtct

SEQ ID NO: 29454 - DNA, 22 bp, Artificial Sequence
  Synthetic Construct
ggtgtggggcaagacttgtttc

SEQ ID NO: 29455 - DNA, 25 bp, Artificial Sequence
  Synthetic Construct
gctctgggctgattgagttgcattc

SEQ ID NO: 29456 - DNA, 22 bp, Artificial Sequence
  Synthetic Construct
ccatcacccgaagcctcacttt

SEQ ID NO: 29457 - DNA, 23 bp, Artificial Sequence
  Synthetic Construct
gccttaggccatgtacaatgtga

SEQ ID NO: 29458 - DNA, 24 bp, Artificial Sequence
  Synthetic Construct
ggctgcacagaccactcaattatc

SEQ ID NO: 29459 - DNA, 28 bp, Artificial Sequence
  Synthetic Construct
ctgtattatccatcacatgagggtcttg

SEQ ID NO: 29460 - DNA, 23 bp, Artificial Sequence
  Synthetic Construct
ctcaccatacggttgtactcaca

SEQ ID NO: 29461 - DNA, 26 bp, Artificial Sequence
  Synthetic Construct
catggaggatttcaaagcaaggaagt

SEQ ID NO: 29462 - DNA, 21 bp, Artificial Sequence
  Synthetic Construct
gctgtcacagactgcatggaa

SEQ ID NO: 29463 - DNA, 26 bp, Artificial Sequence
  Synthetic Construct
caccatcttggtcatctctttctttc

SEQ ID NO: 29464 - DNA, 24 bp, Artificial Sequence
  Synthetic Construct
ggtgagtaccctagcaaccagaag

SEQ ID NO: 29465 - DNA, 20 bp, Artificial Sequence
  Synthetic Construct
atggcccctggaactggaaa

SEQ ID NO: 29466 - DNA, 24 bp, Artificial Sequence
  Synthetic Construct
catggctttctgcagaccattttt

SEQ ID NO: 29467 - DNA, 27 bp, Artificial Sequence
  Synthetic Construct
gtgatatgtgtgcaggtttctctgttt

SEQ ID NO: 29468 - DNA, 24 bp, Artificial Sequence
  Synthetic Construct
tgaatgctgcaagaggaaatggaa

SEQ ID NO: 29469 - DNA, 23 bp, Artificial Sequence
  Synthetic Construct
gacgccatgtgctgtagattact

SEQ ID NO: 29470 - DNA, 26 bp, Artificial Sequence
  Synthetic Construct
cccacagactgattcagagtcgttac

SEQ ID NO: 29471 - DNA, 20 bp, Artificial Sequence
  Synthetic Construct
gaggccgagcagcatttgat

SEQ ID NO: 29472 - DNA, 21 bp, Artificial Sequence
  Synthetic Construct
tcagtggtgcagcatgcttag

SEQ ID NO: 29473 - DNA, 24 bp, Artificial Sequence
  Synthetic Construct
gggtggcacagatatgaggaaaca

SEQ ID NO: 29474 - DNA, 25 bp, Artificial Sequence
  Synthetic Construct
gcacaaccatgtacctttggaaatc

SEQ ID NO: 29475 - DNA, 21 bp, Artificial Sequence
  Synthetic Construct
tgcctcatacagacccgacat

SEQ ID NO: 29476 - DNA, 20 bp, Artificial Sequence
  Synthetic Construct
acatttgccaacccctgctt

SEQ ID NO: 29477 - DNA, 27 bp, Artificial Sequence
  Synthetic Construct
gaggcagtgccaaatatgaactgatac

SEQ ID NO: 29478 - DNA, 23 bp, Artificial Sequence
  Synthetic Construct
gagatcccaaatgccctccaaca

SEQ ID NO: 29479 - DNA, 25 bp, Artificial Sequence
  Synthetic Construct
gcttcttgaggctaggcttggaact

SEQ ID NO: 29480 - DNA, 23 bp, Artificial Sequence
  Synthetic Construct
gtgtgttgcatctccagctaatg

SEQ ID NO: 29481 - DNA, 22 bp, Artificial Sequence
  Synthetic Construct
cagcctccaagttgaacctagt

SEQ ID NO: 29482 - DNA, 22 bp, Artificial Sequence
  Synthetic Construct
agggccacctctctgggtttta

SEQ ID NO: 29483 - DNA, 22 bp, Artificial Sequence
  Synthetic Construct
gcattatggggttgtgggttgt

SEQ ID NO: 29484 - DNA, 22 bp, Artificial Sequence
  Synthetic Construct
cccgaggaagcatttgctgtga

SEQ ID NO: 29485 - DNA, 24 bp, Artificial Sequence
  Synthetic Construct
ggcatggttcttccaactccaagt

SEQ ID NO: 29486 - DNA, 20 bp, Artificial Sequence
  Synthetic Construct
gcctggccacctatcattgt

SEQ ID NO: 29487 - DNA, 21 bp, Artificial Sequence
  Synthetic Construct
tgtggcagtggaaatcccaaa

SEQ ID NO: 29488 - DNA, 22 bp, Artificial Sequence
  Synthetic Construct
gccagcaccccacaaatgttac

SEQ ID NO: 29489 - DNA, 25 bp, Artificial Sequence
  Synthetic Construct
tgcagttccatttccaatagtcaca

SEQ ID NO: 29490 - DNA, 26 bp, Artificial Sequence
  Synthetic Construct
ccccaaactggatgtttttccctcat

SEQ ID NO: 29491 - DNA, 24 bp, Artificial Sequence
  Synthetic Construct
cccacccatgtctgttctctattt

SEQ ID NO: 29492 - DNA, 22 bp, Artificial Sequence
  Synthetic Construct
tgagggaactcccctgaccttt

SEQ ID NO: 29493 - DNA, 20 bp, Artificial Sequence
  Synthetic Construct
ccacctgttcagggccacta

SEQ ID NO: 29494 - DNA, 27 bp, Artificial Sequence
  Synthetic Construct
cttcaactctacatttctgagggtcat

SEQ ID NO: 29495 - DNA, 22 bp, Artificial Sequence
  Synthetic Construct
cccctacacacccatacagaca

SEQ ID NO: 29496 - DNA, 29 bp, Artificial Sequence
  Synthetic Construct
gcaatttgcttaaggacagggattgtatc

SEQ ID NO: 29497 - DNA, 23 bp, Artificial Sequence
  Synthetic Construct
ctccctcaaaattccctggttct

SEQ ID NO: 29498 - DNA, 19 bp, Artificial Sequence
  Synthetic Construct
gcctcagcctcccaaacaa

SEQ ID NO: 29499 - DNA, 26 bp, Artificial Sequence
  Synthetic Construct
tccctggtgtggatcttattttcatc

SEQ ID NO: 29500 - DNA, 20 bp, Artificial Sequence
  Synthetic Construct
gcttccctggagaccacagt

SEQ ID NO: 29501 - DNA, 25 bp, Artificial Sequence
  Synthetic Construct
gggtcttcgacttagcatttagtct

SEQ ID NO: 29502 - DNA, 24 bp, Artificial Sequence
  Synthetic Construct
gctagctcctgtttccatcagcat

SEQ ID NO: 29503 - DNA, 27 bp, Artificial Sequence
  Synthetic Construct
gcttggtccaaaacctcattgatttac

SEQ ID NO: 29504 - DNA, 22 bp, Artificial Sequence
  Synthetic Construct
acacggttgtacatgcgtaaga

SEQ ID NO: 29505 - DNA, 23 bp, Artificial Sequence
  Synthetic Construct
gtgtggaggaaggggaagagttc

SEQ ID NO: 29506 - DNA, 24 bp, Artificial Sequence
  Synthetic Construct
ccccttgctttcatggtaacactt

SEQ ID NO: 29507 - DNA, 25 bp, Artificial Sequence
  Synthetic Construct
gtggctccttttcacatagttgttt

SEQ ID NO: 29508 - DNA, 24 bp, Artificial Sequence
  Synthetic Construct
ggacatgggagcagattttacact

SEQ ID NO: 29509 - DNA, 22 bp, Artificial Sequence
  Synthetic Construct
gcacacatgggttctcagtgat

SEQ ID NO: 29510 - DNA, 24 bp, Artificial Sequence
  Synthetic Construct
cccctaaagccatttcggttcttc

SEQ ID NO: 29511 - DNA, 27 bp, Artificial Sequence
  Synthetic Construct
acatggatagaaaggtctggcttaatg

SEQ ID NO: 29512 - DNA, 20 bp, Artificial Sequence
  Synthetic Construct
cagtttggcccatgctgatg

SEQ ID NO: 29513 - DNA, 26 bp, Artificial Sequence
  Synthetic Construct
cagaacccctcctgaataatggaagt

SEQ ID NO: 29514 - DNA, 20 bp, Artificial Sequence
  Synthetic Construct
accaggccactcccttgtgt

SEQ ID NO: 29515 - DNA, 25 bp, Artificial Sequence
  Synthetic Construct
ggctttcctggatggacaaacagat

SEQ ID NO: 29516 - DNA, 27 bp, Artificial Sequence
  Synthetic Construct
agaatcctgtctatttacaggggtaga

SEQ ID NO: 29517 - DNA, 20 bp, Artificial Sequence
  Synthetic Construct
cagttggcccagtcaaccaa

SEQ ID NO: 29518 - DNA, 24 bp, Artificial Sequence
  Synthetic Construct
ctggcagtgatctctcttttctct

SEQ ID NO: 29519 - DNA, 24 bp, Artificial Sequence
  Synthetic Construct
cccacaagacactacccactccat

SEQ ID NO: 29520 - DNA, 25 bp, Artificial Sequence
  Synthetic Construct
ctcaggaactttggagcatagatca

SEQ ID NO: 29521 - DNA, 26 bp, Artificial Sequence
  Synthetic Construct
catgacagttaaggggagaaggaaaa

SEQ ID NO: 29522 - DNA, 24 bp, Artificial Sequence
  Synthetic Construct
ggcatgtttactccaccaacaaca

SEQ ID NO: 29523 - DNA, 22 bp, Artificial Sequence
  Synthetic Construct
gcttgagaactgaggtgccaaa

SEQ ID NO: 29524 - DNA, 21 bp, Artificial Sequence
  Synthetic Construct
gccatctgctgctgttagcat

SEQ ID NO: 29525 - DNA, 27 bp, Artificial Sequence
  Synthetic Construct
gaccttaggcaaagaggtaacacaaac

SEQ ID NO: 29526 - DNA, 29 bp, Artificial Sequence
  Synthetic Construct
gagagctgagtttaatgagagttgaggtt

SEQ ID NO: 29527 - DNA, 24 bp, Artificial Sequence
  Synthetic Construct
tggagatacagtggttgtgtttga

SEQ ID NO: 29528 - DNA, 28 bp, Artificial Sequence
  Synthetic Construct
gcttctaaaggatacggtgaaagtgtag

SEQ ID NO: 29529 - DNA, 25 bp, Artificial Sequence
  Synthetic Construct
acagtggtagagatgcagaaagatg

SEQ ID NO: 29530 - DNA, 26 bp, Artificial Sequence
  Synthetic Construct
gaggttcaaataaccaagtggagaag

SEQ ID NO: 29531 - DNA, 25 bp, Artificial Sequence
  Synthetic Construct
cccagattcagtcctgtagtgtaac

SEQ ID NO: 29532 - DNA, 29 bp, Artificial Sequence
  Synthetic Construct
gggtgagacaaacataggttctttacttg

SEQ ID NO: 29533 - DNA, 18 bp, Artificial Sequence
  Synthetic Construct
tcgggaccagccatcact

SEQ ID NO: 29534 - DNA, 22 bp, Artificial Sequence
  Synthetic Construct
gcactgttccaatgtccaggtt

SEQ ID NO: 29535 - DNA, 24 bp, Artificial Sequence
  Synthetic Construct
ctgggagtaggcattaacccattg

SEQ ID NO: 29536 - DNA, 27 bp, Artificial Sequence
  Synthetic Construct
tccagcccctacagaattctatttttc

SEQ ID NO: 29537 - DNA, 21 bp, Artificial Sequence
  Synthetic Construct
gctcaagagccacacgaatct

SEQ ID NO: 29538 - DNA, 21 bp, Artificial Sequence
  Synthetic Construct
gggctgtcacctcttctgtga

SEQ ID NO: 29539 - DNA, 22 bp, Artificial Sequence
  Synthetic Construct
acgcttcattccctcagtctca

SEQ ID NO: 29540 - DNA, 20 bp, Artificial Sequence
  Synthetic Construct
gtctggttgcgcagtgaaca

SEQ ID NO: 29541 - DNA, 22 bp, Artificial Sequence
  Synthetic Construct
gccctgctacccctttcctatt

SEQ ID NO: 29542 - DNA, 20 bp, Artificial Sequence
  Synthetic Construct
gcgatgccaggaacatctct

SEQ ID NO: 29543 - DNA, 19 bp, Artificial Sequence
  Synthetic Construct
tggccacacagcctacctt

SEQ ID NO: 29544 - DNA, 30 bp, Artificial Sequence
  Synthetic Construct
ctacctaaacctctaatcacctaagacttg

SEQ ID NO: 29545 - DNA, 25 bp, Artificial Sequence
  Synthetic Construct
ccagagccatgagaggaaaaggatt

SEQ ID NO: 29546 - DNA, 26 bp, Artificial Sequence
  Synthetic Construct
gggtgatgtgagattcccttaactct

SEQ ID NO: 29547 - DNA, 25 bp, Artificial Sequence
  Synthetic Construct
gcactctcaaggcgtaagacctttt

SEQ ID NO: 29548 - DNA, 26 bp, Artificial Sequence
  Synthetic Construct
acataagcccatgccaggataataag

SEQ ID NO: 29549 - DNA, 21 bp, Artificial Sequence
  Synthetic Construct
ccaaccagccagtccaaaaag

SEQ ID NO: 29550 - DNA, 20 bp, Artificial Sequence
  Synthetic Construct
gtcaggctgcgtcattgcta

SEQ ID NO: 29551 - DNA, 23 bp, Artificial Sequence
  Synthetic Construct
cagaagaacgaggaaggaactgt

SEQ ID NO: 29552 - DNA, 24 bp, Artificial Sequence
  Synthetic Construct
ggaggagctggtaagaactagtca

SEQ ID NO: 29553 - DNA, 23 bp, Artificial Sequence
  Synthetic Construct
ccaccagacaactttctcctctt

SEQ ID NO: 29554 - DNA, 27 bp, Artificial Sequence
  Synthetic Construct
gagcaaagaatgtgctataagggagat

SEQ ID NO: 29555 - DNA, 22 bp, Artificial Sequence
  Synthetic Construct
gcatgtgggttttccagcaaat

SEQ ID NO: 29556 - DNA, 24 bp, Artificial Sequence
  Synthetic Construct
actgtccttgctacttgagagact

SEQ ID NO: 29557 - DNA, 25 bp, Artificial Sequence
  Synthetic Construct
acaggtttctttcaagcaggatttc

SEQ ID NO: 29558 - DNA, 22 bp, Artificial Sequence
  Synthetic Construct
gccaagcacataagccatgcta

SEQ ID NO: 29559 - DNA, 23 bp, Artificial Sequence
  Synthetic Construct
tcgctggatttctccaggattac

SEQ ID NO: 29560 - DNA, 21 bp, Artificial Sequence
  Synthetic Construct
gcccagatggagacacagctt

SEQ ID NO: 29561 - DNA, 20 bp, Artificial Sequence
  Synthetic Construct
gtcacagcctgcttgcctat

SEQ ID NO: 29562 - DNA, 28 bp, Artificial Sequence
  Synthetic Construct
cagaaataggaccttttggggttcattc

SEQ ID NO: 29563 - DNA, 22 bp, Artificial Sequence
  Synthetic Construct
gagtggacacagatcccacaca

SEQ ID NO: 29564 - DNA, 22 bp, Artificial Sequence
  Synthetic Construct
gcctcctgtgtgaaggtcgaaa

SEQ ID NO: 29565 - DNA, 20 bp, Artificial Sequence
  Synthetic Construct
cctgccccaaactccaaaga

SEQ ID NO: 29566 - DNA, 19 bp, Artificial Sequence
  Synthetic Construct
taggtgcccgaggccaaac

SEQ ID NO: 29567 - DNA, 25 bp, Artificial Sequence
  Synthetic Construct
ggaggacaaaaggagctctattcaa

SEQ ID NO: 29568 - DNA, 25 bp, Artificial Sequence
  Synthetic Construct
cctggagtgtgggcaggtatttttc

SEQ ID NO: 29569 - DNA, 26 bp, Artificial Sequence
  Synthetic Construct
ctggtgatcactttacccttctgtga

SEQ ID NO: 29570 - DNA, 24 bp, Artificial Sequence
  Synthetic Construct
ttcagagtcccgtgagttatccta

SEQ ID NO: 29571 - DNA, 25 bp, Artificial Sequence
  Synthetic Construct
cagttaagcctctttgatgggaatg

SEQ ID NO: 29572 - DNA, 21 bp, Artificial Sequence
  Synthetic Construct
tcttaggggaggccagaccaa

SEQ ID NO: 29573 - DNA, 27 bp, Artificial Sequence
  Synthetic Construct
ggtggaatgtctgtggaatgttagtga

SEQ ID NO: 29574 - DNA, 22 bp, Artificial Sequence
  Synthetic Construct
atgagacaagcagctccgttta

SEQ ID NO: 29575 - DNA, 20 bp, Artificial Sequence
  Synthetic Construct
caccagctgccctctaggaa

SEQ ID NO: 29576 - DNA, 26 bp, Artificial Sequence
  Synthetic Construct
gacttgaaacattgctctcctaccta

SEQ ID NO: 29577 - DNA, 24 bp, Artificial Sequence
  Synthetic Construct
ctgtttcaatcctggactgtctgt

SEQ ID NO: 29578 - DNA, 20 bp, Artificial Sequence
  Synthetic Construct
accccttccctgcttcttgt

SEQ ID NO: 29579 - DNA, 24 bp, Artificial Sequence
  Synthetic Construct
ggctctcaacatgcagaccttgat

SEQ ID NO: 29580 - DNA, 23 bp, Artificial Sequence
  Synthetic Construct
gggaggaggtaggaggttgtaaa

SEQ ID NO: 29581 - DNA, 23 bp, Artificial Sequence
  Synthetic Construct
gcccaggggactattttgtctgt

SEQ ID NO: 29582 - DNA, 23 bp, Artificial Sequence
  Synthetic Construct
ccctaatggtccagccaacatac

SEQ ID NO: 29583 - DNA, 22 bp, Artificial Sequence
  Synthetic Construct
agcgcctgtgaactcaggaatg

SEQ ID NO: 29584 - DNA, 27 bp, Artificial Sequence
  Synthetic Construct
gtagtccaccatcctgataaggttaag

SEQ ID NO: 29585 - DNA, 22 bp, Artificial Sequence
  Synthetic Construct
ccttataccccacctccacgaa

SEQ ID NO: 29586 - DNA, 23 bp, Artificial Sequence
  Synthetic Construct
cgcaaaggattttgtccttcact

SEQ ID NO: 29587 - DNA, 23 bp, Artificial Sequence
  Synthetic Construct
cagcagcagcaaacttgtctatt

SEQ ID NO: 29588 - DNA, 22 bp, Artificial Sequence
  Synthetic Construct
caccggtgggtttgtagcagat

SEQ ID NO: 29589 - DNA, 22 bp, Artificial Sequence
  Synthetic Construct
tgtccttgggaggagagctagt

SEQ ID NO: 29590 - DNA, 20 bp, Artificial Sequence
  Synthetic Construct
agctacggcccatgacaaga

SEQ ID NO: 29591 - DNA, 27 bp, Artificial Sequence
  Synthetic Construct
ccagcttagccctaaataaagcacagt

SEQ ID NO: 29592 - DNA, 23 bp, Artificial Sequence
  Synthetic Construct
ggtgtgggaccatggagacaaat

SEQ ID NO: 29593 - DNA, 26 bp, Artificial Sequence
  Synthetic Construct
caattgcagtaagggagaacacaaac

SEQ ID NO: 29594 - DNA, 29 bp, Artificial Sequence
  Synthetic Construct
ggccttatcatgatctgaggatgaagttt

SEQ ID NO: 29595 - DNA, 26 bp, Artificial Sequence
  Synthetic Construct
gttgcaatctagtggcagtttctaag

SEQ ID NO: 29596 - DNA, 27 bp, Artificial Sequence
  Synthetic Construct
gatttgttgttaggtcactccaacttc

SEQ ID NO: 29597 - DNA, 24 bp, Artificial Sequence
  Synthetic Construct
cgctctgagacagccatacatttg

SEQ ID NO: 29598 - DNA, 22 bp, Artificial Sequence
  Synthetic Construct
ccaaggtcactgcctctcatgt

SEQ ID NO: 29599 - DNA, 24 bp, Artificial Sequence
  Synthetic Construct
cagctccgtcctttcattcttaca

SEQ ID NO: 29600 - DNA, 21 bp, Artificial Sequence
  Synthetic Construct
cttgtctgctgggctgttcta

SEQ ID NO: 29601 - DNA, 24 bp, Artificial Sequence
  Synthetic Construct
cagggatcagacagagacattgtt

SEQ ID NO: 29602 - DNA, 25 bp, Artificial Sequence
  Synthetic Construct
agtacaagactgtgagtcaggagat

SEQ ID NO: 29603 - DNA, 20 bp, Artificial Sequence
  Synthetic Construct
gtgaagccagaggtgctctt

SEQ ID NO: 29604 - DNA, 26 bp, Artificial Sequence
  Synthetic Construct
ctctgagcaacagaattcccacagat

SEQ ID NO: 29605 - DNA, 27 bp, Artificial Sequence
  Synthetic Construct
ctgtgccaccgtctatgtaatttatgt

SEQ ID NO: 29606 - DNA, 24 bp, Artificial Sequence
  Synthetic Construct
caacaagattcagtgccaggaaca

SEQ ID NO: 29607 - DNA, 23 bp, Artificial Sequence
  Synthetic Construct
gaatatagcggccagagtgatga

SEQ ID NO: 29608 - DNA, 25 bp, Artificial Sequence
  Synthetic Construct
agaggacgtggttatcttgtcaatg

SEQ ID NO: 29609 - DNA, 27 bp, Artificial Sequence
  Synthetic Construct
ggcttcatagccatcttcaaggaccta

SEQ ID NO: 29610 - DNA, 27 bp, Artificial Sequence
  Synthetic Construct
gcctacttctcacatcacagctctcta

SEQ ID NO: 29611 - DNA, 26 bp, Artificial Sequence
  Synthetic Construct
catgtaagagccttcagatcctgtct

SEQ ID NO: 29612 - DNA, 22 bp, Artificial Sequence
  Synthetic Construct
cgagtccatgtgcagaaagaac

SEQ ID NO: 29613 - DNA, 23 bp, Artificial Sequence
  Synthetic Construct
ggcttgtcctgcttccaaacact

SEQ ID NO: 29614 - DNA, 25 bp, Artificial Sequence
  Synthetic Construct
ggagaaatccctattctccctgttg

SEQ ID NO: 29615 - DNA, 24 bp, Artificial Sequence
  Synthetic Construct
ctgtgtaagcaggatcaccgatct

SEQ ID NO: 29616 - DNA, 22 bp, Artificial Sequence
  Synthetic Construct
gaaactggtccggaggatgaga

SEQ ID NO: 29617 - DNA, 27 bp, Artificial Sequence
  Synthetic Construct
agggagaggcaaataagtatgtgtaac

SEQ ID NO: 29618 - DNA, 27 bp, Artificial Sequence
  Synthetic Construct
agggagctagtatggtctttagagtaa

SEQ ID NO: 29619 - DNA, 24 bp, Artificial Sequence
  Synthetic Construct
cctaaatcgtctgctggtgtccat

SEQ ID NO: 29620 - DNA, 22 bp, Artificial Sequence
  Synthetic Construct
tcctcctcccacctccttaaaa

SEQ ID NO: 29621 - DNA, 26 bp, Artificial Sequence
  Synthetic Construct
caccaccaaatcagagaattgccttt

SEQ ID NO: 29622 - DNA, 23 bp, Artificial Sequence
  Synthetic Construct
tggagactggtcatgtacacaca

SEQ ID NO: 29623 - DNA, 24 bp, Artificial Sequence
  Synthetic Construct
tggttttccatctgctcacttttc

SEQ ID NO: 29624 - DNA, 25 bp, Artificial Sequence
  Synthetic Construct
gaatggtggaagggtaatgtcaatg

SEQ ID NO: 29625 - DNA, 25 bp, Artificial Sequence
  Synthetic Construct
gtgataatctgctcctagctgaaca

SEQ ID NO: 29626 - DNA, 27 bp, Artificial Sequence
  Synthetic Construct
ggacaggacagaggattcatgctaatg

SEQ ID NO: 29627 - DNA, 24 bp, Artificial Sequence
  Synthetic Construct
agactggatgctgaaatccttgaa

SEQ ID NO: 29628 - DNA, 22 bp, Artificial Sequence
  Synthetic Construct
tcatggctcccctcacttccta

SEQ ID NO: 29629 - DNA, 24 bp, Artificial Sequence
  Synthetic Construct
ccaggccagttctgagaggaaaca

SEQ ID NO: 29630 - DNA, 23 bp, Artificial Sequence
  Synthetic Construct
gggtgacagcttcttcctaatgt

SEQ ID NO: 29631 - DNA, 27 bp, Artificial Sequence
  Synthetic Construct
gcatccagttatccagagagcatgagt

SEQ ID NO: 29632 - DNA, 27 bp, Artificial Sequence
  Synthetic Construct
gtcaagggagactagtaagtgggtctt

SEQ ID NO: 29633 - DNA, 25 bp, Artificial Sequence
  Synthetic Construct
cagagaagcaaaatgtgatctgtgt

SEQ ID NO: 29634 - DNA, 25 bp, Artificial Sequence
  Synthetic Construct
caggcctgagagaaattcacagttg

SEQ ID NO: 29635 - DNA, 22 bp, Artificial Sequence
  Synthetic Construct
tgcagaggacccactagtccaa

SEQ ID NO: 29636 - DNA, 25 bp, Artificial Sequence
  Synthetic Construct
gtcgttaggcgatgcatgattgtaa

SEQ ID NO: 29637 - DNA, 26 bp, Artificial Sequence
  Synthetic Construct
gcggtttgaggtataaatggaagtga

SEQ ID NO: 29638 - DNA, 30 bp, Artificial Sequence
  Synthetic Construct
gacatgaagactcgctttgcaattgtattc

SEQ ID NO: 29639 - DNA, 26 bp, Artificial Sequence
  Synthetic Construct
ggcactagaggcttaagcacaaactt

SEQ ID NO: 29640 - DNA, 24 bp, Artificial Sequence
  Synthetic Construct
ggtttaggaagcctctctctccaa

SEQ ID NO: 29641 - DNA, 25 bp, Artificial Sequence
  Synthetic Construct
gacagttttcactttgcaggaagta

SEQ ID NO: 29642 - DNA, 25 bp, Artificial Sequence
  Synthetic Construct
ggccaaattatgggtgggttagcaa

SEQ ID NO: 29643 - DNA, 23 bp, Artificial Sequence
  Synthetic Construct
ggtactgggcattgtacttgact

SEQ ID NO: 29644 - DNA, 24 bp, Artificial Sequence
  Synthetic Construct
gcttccatgagctgtcctcaatct

SEQ ID NO: 29645 - DNA, 21 bp, Artificial Sequence
  Synthetic Construct
accctctcccagccctgaaaa

SEQ ID NO: 29646 - DNA, 22 bp, Artificial Sequence
  Synthetic Construct
gggctctctgagtgaaggatgt

SEQ ID NO: 29647 - DNA, 22 bp, Artificial Sequence
  Synthetic Construct
gtggccttcctctgaatgaagt

SEQ ID NO: 29648 - DNA, 28 bp, Artificial Sequence
  Synthetic Construct
gacagagcagaggtaatgggtatacttg

SEQ ID NO: 29649 - DNA, 24 bp, Artificial Sequence
  Synthetic Construct
ccatccatgtcccaatccagagtt

SEQ ID NO: 29650 - DNA, 26 bp, Artificial Sequence
  Synthetic Construct
gcacacaacactacccatttttctga

SEQ ID NO: 29651 - DNA, 26 bp, Artificial Sequence
  Synthetic Construct
cgattgtattgcctttgctcctttgt

SEQ ID NO: 29652 - DNA, 24 bp, Artificial Sequence
  Synthetic Construct
ggccagagatagcatcctctgaat

SEQ ID NO: 29653 - DNA, 19 bp, Artificial Sequence
  Synthetic Construct
cgagcctgctccccttaca

SEQ ID NO: 29654 - DNA, 22 bp, Artificial Sequence
  Synthetic Construct
gcctccaaagtgacaggagtga

SEQ ID NO: 29655 - DNA, 22 bp, Artificial Sequence
  Synthetic Construct
ggtgggcaaggatgctactcaa

SEQ ID NO: 29656 - DNA, 22 bp, Artificial Sequence
  Synthetic Construct
cctgggcagttcagcttgttgt

SEQ ID NO: 29657 - DNA, 21 bp, Artificial Sequence
  Synthetic Construct
tctgcctagaaacgggtctga

SEQ ID NO: 29658 - DNA, 22 bp, Artificial Sequence
  Synthetic Construct
gccctcaaagacctcacagatt

SEQ ID NO: 29659 - DNA, 25 bp, Artificial Sequence
  Synthetic Construct
gctcctgacctcacaacaactttct

SEQ ID NO: 29660 - DNA, 23 bp, Artificial Sequence
  Synthetic Construct
ggcacaaacctgagaacttgaac

SEQ ID NO: 29661 - DNA, 22 bp, Artificial Sequence
  Synthetic Construct
cgctagccaggtttccgtttag

SEQ ID NO: 29662 - DNA, 22 bp, Artificial Sequence
  Synthetic Construct
gcgaaggacgtcagcgatgtaa

SEQ ID NO: 29663 - DNA, 27 bp, Artificial Sequence
  Synthetic Construct
gattgtggtataaggtgggtttagttg

SEQ ID NO: 29664 - DNA, 26 bp, Artificial Sequence
  Synthetic Construct
ctctcaaaggcttttacctgggagta

SEQ ID NO: 29665 - DNA, 23 bp, Artificial Sequence
  Synthetic Construct
ccaacctagccccactaatttct

SEQ ID NO: 29666 - DNA, 24 bp, Artificial Sequence
  Synthetic Construct
cagaaagttcaccagagcacaatc

SEQ ID NO: 29667 - DNA, 22 bp, Artificial Sequence
  Synthetic Construct
gggagtatgcccctttgctgtt

SEQ ID NO: 29668 - DNA, 22 bp, Artificial Sequence
  Synthetic Construct
gtcagcaagaaccccttcaagt

SEQ ID NO: 29669 - DNA, 20 bp, Artificial Sequence
  Synthetic Construct
gctgtggtgatcgtggttgt

SEQ ID NO: 29670 - DNA, 27 bp, Artificial Sequence
  Synthetic Construct
tctttccccatctagaatgctcttttc

SEQ ID NO: 29671 - DNA, 20 bp, Artificial Sequence
  Synthetic Construct
caggctgctcttgggaagtt

SEQ ID NO: 29672 - DNA, 28 bp, Artificial Sequence
  Synthetic Construct
ctccctagagaatcctaagaccaaccaa

SEQ ID NO: 29673 - DNA, 22 bp, Artificial Sequence
  Synthetic Construct
gcatggctgaagctgaatcttg

SEQ ID NO: 29674 - DNA, 22 bp, Artificial Sequence
  Synthetic Construct
gcccacagtggttcagtcttag

SEQ ID NO: 29675 - DNA, 19 bp, Artificial Sequence
  Synthetic Construct
gccggagagcaacgcacat

SEQ ID NO: 29676 - DNA, 26 bp, Artificial Sequence
  Synthetic Construct
gcaggctaagattactcgtctaaaca

SEQ ID NO: 29677 - DNA, 27 bp, Artificial Sequence
  Synthetic Construct
gaacttgaatctgaagggactatggat

SEQ ID NO: 29678 - DNA, 23 bp, Artificial Sequence
  Synthetic Construct
gcaggctgtgagaccatgaaaac

SEQ ID NO: 29679 - DNA, 24 bp, Artificial Sequence
  Synthetic Construct
caaggagacagatccttgggaaag

SEQ ID NO: 29680 - DNA, 22 bp, Artificial Sequence
  Synthetic Construct
ggcaggaactcaggactcaaga

SEQ ID NO: 29681 - DNA, 22 bp, Artificial Sequence
  Synthetic Construct
gccaccctccactacactccat

SEQ ID NO: 29682 - DNA, 24 bp, Artificial Sequence
  Synthetic Construct
ccaagaggaactttttggcactga

SEQ ID NO: 29683 - DNA, 20 bp, Artificial Sequence
  Synthetic Construct
gcccacctttggccttctct

SEQ ID NO: 29684 - DNA, 22 bp, Artificial Sequence
  Synthetic Construct
ggggagaggcactgaatacctt

SEQ ID NO: 29685 - DNA, 22 bp, Artificial Sequence
  Synthetic Construct
gcttacagtagatgcgggaaga

SEQ ID NO: 29686 - DNA, 23 bp, Artificial Sequence
  Synthetic Construct
agctgagcatcggtaaattccaa

SEQ ID NO: 29687 - DNA, 23 bp, Artificial Sequence
  Synthetic Construct
ccatggctgaccatgaactctac

SEQ ID NO: 29688 - DNA, 24 bp, Artificial Sequence
  Synthetic Construct
caccagatggctgattgtctcttc

SEQ ID NO: 29689 - DNA, 24 bp, Artificial Sequence
  Synthetic Construct
gcatgcctgggaggtaaagaattg

SEQ ID NO: 29690 - DNA, 22 bp, Artificial Sequence
  Synthetic Construct
ctgctggggaaccagttgcata

SEQ ID NO: 29691 - DNA, 22 bp, Artificial Sequence
  Synthetic Construct
ccacgcctctcagtggtagaat

SEQ ID NO: 29692 - DNA, 26 bp, Artificial Sequence
  Synthetic Construct
ctggctcatatcctacgaatccatct

SEQ ID NO: 29693 - DNA, 26 bp, Artificial Sequence
  Synthetic Construct
gtctacactgatttctggaacgatga

SEQ ID NO: 29694 - DNA, 30 bp, Artificial Sequence
  Synthetic Construct
gcagttatcagaaacagacagagtaggtaa

SEQ ID NO: 29695 - DNA, 23 bp, Artificial Sequence
  Synthetic Construct
cctgccgactcattctccctatg

SEQ ID NO: 29696 - DNA, 22 bp, Artificial Sequence
  Synthetic Construct
gcccacaactcagtagccctaa

SEQ ID NO: 29697 - DNA, 23 bp, Artificial Sequence
  Synthetic Construct
gcatgcaggaaagtcaaatccat

SEQ ID NO: 29698 - DNA, 22 bp, Artificial Sequence
  Synthetic Construct
ccaaatttctggcctccacttg

SEQ ID NO: 29699 - DNA, 24 bp, Artificial Sequence
  Synthetic Construct
tctctcacgacagcaattggttat

SEQ ID NO: 29700 - DNA, 23 bp, Artificial Sequence
  Synthetic Construct
cagctgttgcccaagctttcatc

SEQ ID NO: 29701 - DNA, 23 bp, Artificial Sequence
  Synthetic Construct
ggcctgtagtgggaagaagtgaa

SEQ ID NO: 29702 - DNA, 22 bp, Artificial Sequence
  Synthetic Construct
ggtccaggtctgtgcaggaatc

SEQ ID NO: 29703 - DNA, 23 bp, Artificial Sequence
  Synthetic Construct
ctcaacacaatgctcgtcacaca

SEQ ID NO: 29704 - DNA, 25 bp, Artificial Sequence
  Synthetic Construct
cactgaatggcatggggagaaatgt

SEQ ID NO: 29705 - DNA, 20 bp, Artificial Sequence
  Synthetic Construct
accacagcccctgctgactt

SEQ ID NO: 29706 - DNA, 24 bp, Artificial Sequence
  Synthetic Construct
gttcagtgactctcacccacaagt

SEQ ID NO: 29707 - DNA, 24 bp, Artificial Sequence
  Synthetic Construct
gccagtgactttgatgggagaaga

SEQ ID NO: 29708 - DNA, 22 bp, Artificial Sequence
  Synthetic Construct
tccaaggccccttctagacttg

SEQ ID NO: 29709 - DNA, 20 bp, Artificial Sequence
  Synthetic Construct
agcctcctgaggccagaaaa

SEQ ID NO: 29710 - DNA, 21 bp, Artificial Sequence
  Synthetic Construct
tgtcctaagcccagtgcaaga

SEQ ID NO: 29711 - DNA, 23 bp, Artificial Sequence
  Synthetic Construct
ctgcgatgtgccaagtatttgat

SEQ ID NO: 29712 - DNA, 23 bp, Artificial Sequence
  Synthetic Construct
ccagtgaggaacattgcctggat

SEQ ID NO: 29713 - DNA, 20 bp, Artificial Sequence
  Synthetic Construct
agccggcaggaggaggaaga

SEQ ID NO: 29714 - DNA, 24 bp, Artificial Sequence
  Synthetic Construct
gacctggctgaaaagtctgtaagt

SEQ ID NO: 29715 - DNA, 21 bp, Artificial Sequence
  Synthetic Construct
ggtcctaactgcccctgttca

SEQ ID NO: 29716 - DNA, 22 bp, Artificial Sequence
  Synthetic Construct
gctggggaaagaggctgagtaa

SEQ ID NO: 29717 - DNA, 24 bp, Artificial Sequence
  Synthetic Construct
cctttgcagtcaccaatgttttgt

SEQ ID NO: 29718 - DNA, 22 bp, Artificial Sequence
  Synthetic Construct
gggttctggtgcttggggttta

SEQ ID NO: 29719 - DNA, 27 bp, Artificial Sequence
  Synthetic Construct
caaggtgttaattgacctctctgttga

SEQ ID NO: 29720 - DNA, 23 bp, Artificial Sequence
  Synthetic Construct
ccatgccctgggattaaggtcaa

SEQ ID NO: 29721 - DNA, 24 bp, Artificial Sequence
  Synthetic Construct
ctgcaggtaacaatgcaacacaag

SEQ ID NO: 29722 - DNA, 22 bp, Artificial Sequence
  Synthetic Construct
tgcaacgaactttctcctccat

SEQ ID NO: 29723 - DNA, 22 bp, Artificial Sequence
  Synthetic Construct
ccttcctgggacatgaatgtga

SEQ ID NO: 29724 - DNA, 23 bp, Artificial Sequence
  Synthetic Construct
cgggagggaaggggagaaattag

SEQ ID NO: 29725 - DNA, 24 bp, Artificial Sequence
  Synthetic Construct
gtctctgaagtccaggctagtgat

SEQ ID NO: 29726 - DNA, 22 bp, Artificial Sequence
  Synthetic Construct
gcagtgaggggcagaaattagt

SEQ ID NO: 29727 - DNA, 24 bp, Artificial Sequence
  Synthetic Construct
cttcttctgactacagggcttgtt

SEQ ID NO: 29728 - DNA, 25 bp, Artificial Sequence
  Synthetic Construct
tggcagactactcaaacacattttc

SEQ ID NO: 29729 - DNA, 21 bp, Artificial Sequence
  Synthetic Construct
agggcccaacagtctggaaga

SEQ ID NO: 29730 - DNA, 26 bp, Artificial Sequence
  Synthetic Construct
gagatgttcatgtatggcatggtttc

SEQ ID NO: 29731 - DNA, 20 bp, Artificial Sequence
  Synthetic Construct
tggctgtggcaggctattct

SEQ ID NO: 29732 - DNA, 24 bp, Artificial Sequence
  Synthetic Construct
ccctgaatctgaagagccaaatct

SEQ ID NO: 29733 - DNA, 21 bp, Artificial Sequence
  Synthetic Construct
ggcgccctgccatacaataag

SEQ ID NO: 29734 - DNA, 22 bp, Artificial Sequence
  Synthetic Construct
aacaggccgcttaagagttaca

SEQ ID NO: 29735 - DNA, 25 bp, Artificial Sequence
  Synthetic Construct
ctcaaggtgacagctaattgcaaca

SEQ ID NO: 29736 - DNA, 20 bp, Artificial Sequence
  Synthetic Construct
cctctcaatctgccctgcaa

SEQ ID NO: 29737 - DNA, 23 bp, Artificial Sequence
  Synthetic Construct
cgggatcgtgagtaagagccaat

SEQ ID NO: 29738 - DNA, 24 bp, Artificial Sequence
  Synthetic Construct
cctggccttagagaaattcacagt

SEQ ID NO: 29739 - DNA, 20 bp, Artificial Sequence
  Synthetic Construct
gcgctgaagcccagcagtaa

SEQ ID NO: 29740 - DNA, 26 bp, Artificial Sequence
  Synthetic Construct
gccagaatggcttgtaggttcctttg

SEQ ID NO: 29741 - DNA, 26 bp, Artificial Sequence
  Synthetic Construct
gtcacttgcatccaagagtcttcatt

SEQ ID NO: 29742 - DNA, 23 bp, Artificial Sequence
  Synthetic Construct
cgtctgtggtgagaagtgactgt

SEQ ID NO: 29743 - DNA, 24 bp, Artificial Sequence
  Synthetic Construct
ggaagccaaatacgcacccctaac

SEQ ID NO: 29744 - DNA, 22 bp, Artificial Sequence
  Synthetic Construct
gagagcatctctcaagccaaca

SEQ ID NO: 29745 - DNA, 21 bp, Artificial Sequence
  Synthetic Construct
ctgcttctcccttgggaatgt

SEQ ID NO: 29746 - DNA, 22 bp, Artificial Sequence
  Synthetic Construct
gcaccttgcagccttaggaact

SEQ ID NO: 29747 - DNA, 22 bp, Artificial Sequence
  Synthetic Construct
actccattcccaaccctcttct

SEQ ID NO: 29748 - DNA, 23 bp, Artificial Sequence
  Synthetic Construct
ggacacctgaagttccttgacat

SEQ ID NO: 29749 - DNA, 22 bp, Artificial Sequence
  Synthetic Construct
gtgccaggtatgctggaagaca

SEQ ID NO: 29750 - DNA, 24 bp, Artificial Sequence
  Synthetic Construct
gcttcagggtcagtgcaaggtaac

SEQ ID NO: 29751 - DNA, 25 bp, Artificial Sequence
  Synthetic Construct
gcaagtccaacaattcgaagactac

SEQ ID NO: 29752 - DNA, 26 bp, Artificial Sequence
  Synthetic Construct
tggaaatgctagtacctactgctcta

SEQ ID NO: 29753 - DNA, 23 bp, Artificial Sequence
  Synthetic Construct
gtgggaattcagctccacataga

SEQ ID NO: 29754 - DNA, 26 bp, Artificial Sequence
  Synthetic Construct
gggaagtgacatacttactgctctga

SEQ ID NO: 29755 - DNA, 22 bp, Artificial Sequence
  Synthetic Construct
ccaaggtgacataggcggaaag

SEQ ID NO: 29756 - DNA, 24 bp, Artificial Sequence
  Synthetic Construct
cacaaagggcaatgtcaaatgtgt

SEQ ID NO: 29757 - DNA, 25 bp, Artificial Sequence
  Synthetic Construct
tgaacaatccagttgtcctcagttc

SEQ ID NO: 29758 - DNA, 24 bp, Artificial Sequence
  Synthetic Construct
tgcatgatggacaaggaaggttag

SEQ ID NO: 29759 - DNA, 22 bp, Artificial Sequence
  Synthetic Construct
gcccaacctggaaaggcttctt

SEQ ID NO: 29760 - DNA, 20 bp, Artificial Sequence
  Synthetic Construct
gcaagcgctgaagcttggaa

SEQ ID NO: 29761 - DNA, 27 bp, Artificial Sequence
  Synthetic Construct
cccaatagaagcaggtcagtacagttc

SEQ ID NO: 29762 - DNA, 24 bp, Artificial Sequence
  Synthetic Construct
gcaggaatggacatgggttttagt

SEQ ID NO: 29763 - DNA, 22 bp, Artificial Sequence
  Synthetic Construct
ggggagaccaaggaccactact

SEQ ID NO: 29764 - DNA, 25 bp, Artificial Sequence
  Synthetic Construct
gtgatttttcccaaggtccctaaga

SEQ ID NO: 29765 - DNA, 27 bp, Artificial Sequence
  Synthetic Construct
gcttatttaaggaaccaaacgggcttt

SEQ ID NO: 29766 - DNA, 22 bp, Artificial Sequence
  Synthetic Construct
gtggctggcagtacagacacat

SEQ ID NO: 29767 - DNA, 25 bp, Artificial Sequence
  Synthetic Construct
cagagacagaaggaaaaccagactt

SEQ ID NO: 29768 - DNA, 22 bp, Artificial Sequence
  Synthetic Construct
gggaaggctcaggacatacttc

SEQ ID NO: 29769 - DNA, 26 bp, Artificial Sequence
  Synthetic Construct
gagaaaggaggagctgcttatagagt

SEQ ID NO: 29770 - DNA, 26 bp, Artificial Sequence
  Synthetic Construct
ctgtatcctctgaagttcccttgtgt

SEQ ID NO: 29771 - DNA, 24 bp, Artificial Sequence
  Synthetic Construct
ggactcctttgaggtgtgggtctt

SEQ ID NO: 29772 - DNA, 24 bp, Artificial Sequence
  Synthetic Construct
ccttgactgtgggaatgacattga

SEQ ID NO: 29773 - DNA, 22 bp, Artificial Sequence
  Synthetic Construct
cctccagcacctcatcatccat

SEQ ID NO: 29774 - DNA, 23 bp, Artificial Sequence
  Synthetic Construct
gtgacgtccacctgatgtcacaa

SEQ ID NO: 29775 - DNA, 24 bp, Artificial Sequence
  Synthetic Construct
acagctgaggttaagctttgttca

SEQ ID NO: 29776 - DNA, 23 bp, Artificial Sequence
  Synthetic Construct
ctgcctgaagctctgttcctttc

SEQ ID NO: 29777 - DNA, 22 bp, Artificial Sequence
  Synthetic Construct
cctctccgactttcctgcatgt

SEQ ID NO: 29778 - DNA, 26 bp, Artificial Sequence
  Synthetic Construct
gcactgggaatttgtggttaacattg

SEQ ID NO: 29779 - DNA, 25 bp, Artificial Sequence
  Synthetic Construct
gggacactgtagatcagtggttaaa

SEQ ID NO: 29780 - DNA, 20 bp, Artificial Sequence
  Synthetic Construct
atggcccatggggtcacagt

SEQ ID NO: 29781 - DNA, 22 bp, Artificial Sequence
  Synthetic Construct
tcctgcaaggagactggaggaa

SEQ ID NO: 29782 - DNA, 25 bp, Artificial Sequence
  Synthetic Construct
tgtggcaaaccatttatctggtaac

SEQ ID NO: 29783 - DNA, 26 bp, Artificial Sequence
  Synthetic Construct
ccagagggtgacatattttctcatgt

SEQ ID NO: 29784 - DNA, 22 bp, Artificial Sequence
  Synthetic Construct
cctttcagaggacaccctgatg

SEQ ID NO: 29785 - DNA, 23 bp, Artificial Sequence
  Synthetic Construct
catggctaacagcctgggtattg

SEQ ID NO: 29786 - DNA, 26 bp, Artificial Sequence
  Synthetic Construct
gactttcagtagggtaccccagattc

SEQ ID NO: 29787 - DNA, 27 bp, Artificial Sequence
  Synthetic Construct
cagctgcttgctaaatactccatttgt

SEQ ID NO: 29788 - DNA, 23 bp, Artificial Sequence
  Synthetic Construct
gtcctgcatctctcaccacttac

SEQ ID NO: 29789 - DNA, 26 bp, Artificial Sequence
  Synthetic Construct
gtgtggaaaaggttaaggagacagaa

SEQ ID NO: 29790 - DNA, 23 bp, Artificial Sequence
  Synthetic Construct
tgcctcccaagtaggatagaact

SEQ ID NO: 29791 - DNA, 22 bp, Artificial Sequence
  Synthetic Construct
cccgctgaacaggttcttgagt

SEQ ID NO: 29792 - DNA, 30 bp, Artificial Sequence
  Synthetic Construct
ccatctaaccatccacctcatttttcaaac

SEQ ID NO: 29793 - DNA, 24 bp, Artificial Sequence
  Synthetic Construct
ccagagcactcctctcccaaaaag

SEQ ID NO: 29794 - DNA, 25 bp, Artificial Sequence
  Synthetic Construct
cttctcagtctgtatgcctgactct

SEQ ID NO: 29795 - DNA, 24 bp, Artificial Sequence
  Synthetic Construct
gtattaccgcaaagggagcaaatg

SEQ ID NO: 29796 - DNA, 28 bp, Artificial Sequence
  Synthetic Construct
ccagtatccactctaacagtcaaaggaa

SEQ ID NO: 29797 - DNA, 23 bp, Artificial Sequence
  Synthetic Construct
ctgcacactgttggcaatgactt

SEQ ID NO: 29798 - DNA, 22 bp, Artificial Sequence
  Synthetic Construct
aacccaggagcctcagagatga

SEQ ID NO: 29799 - DNA, 29 bp, Artificial Sequence
  Synthetic Construct
cagatccacaaaatcaggtctcacctatc

SEQ ID NO: 29800 - DNA, 23 bp, Artificial Sequence
  Synthetic Construct
ggaaagaaaagggtgctctggat

SEQ ID NO: 29801 - DNA, 24 bp, Artificial Sequence
  Synthetic Construct
ggacagatcctgcctgtaccattg

SEQ ID NO: 29802 - DNA, 24 bp, Artificial Sequence
  Synthetic Construct
ctgtaactcccatcgtagccttct

SEQ ID NO: 29803 - DNA, 23 bp, Artificial Sequence
  Synthetic Construct
ggggagaagaaagggaggacaaa

SEQ ID NO: 29804 - DNA, 23 bp, Artificial Sequence
  Synthetic Construct
gtgatgcacaaaaacaggcacaa

SEQ ID NO: 29805 - DNA, 20 bp, Artificial Sequence
  Synthetic Construct
cagggcctcctgacctgttc

SEQ ID NO: 29806 - DNA, 24 bp, Artificial Sequence
  Synthetic Construct
acttcatccctcgagttgtgtatc

SEQ ID NO: 29807 - DNA, 18 bp, Artificial Sequence
  Synthetic Construct
aacgtggccaggccttca

SEQ ID NO: 29808 - DNA, 28 bp, Artificial Sequence
  Synthetic Construct
gcagcgtgaaaacggactaatacaaaac

SEQ ID NO: 29809 - DNA, 24 bp, Artificial Sequence
  Synthetic Construct
ctgcattgtgaggacacagcattc

SEQ ID NO: 29810 - DNA, 26 bp, Artificial Sequence
  Synthetic Construct
ggatatcagtttgtttcccaggcttt

SEQ ID NO: 29811 - DNA, 22 bp, Artificial Sequence
  Synthetic Construct
tccttctcccctgtctgtgaag

SEQ ID NO: 29812 - DNA, 27 bp, Artificial Sequence
  Synthetic Construct
ggagatgagactgaaaataggtaggtt

SEQ ID NO: 29813 - DNA, 25 bp, Artificial Sequence
  Synthetic Construct
gcctaggattcttcgcaagcaggta

SEQ ID NO: 29814 - DNA, 21 bp, Artificial Sequence
  Synthetic Construct
tcggtagctgtgggaggtaga

SEQ ID NO: 29815 - DNA, 22 bp, Artificial Sequence
  Synthetic Construct
ccttggcacctccaaatactct

SEQ ID NO: 29816 - DNA, 26 bp, Artificial Sequence
  Synthetic Construct
gaaatggagccattaggtaaggtgtt

SEQ ID NO: 29817 - DNA, 23 bp, Artificial Sequence
  Synthetic Construct
gctggcataggtagccaggaaac

SEQ ID NO: 29818 - DNA, 22 bp, Artificial Sequence
  Synthetic Construct
aggggacaggtgagccagaaat

SEQ ID NO: 29819 - DNA, 21 bp, Artificial Sequence
  Synthetic Construct
ttgctgggctgtgggcacttc

SEQ ID NO: 29820 - DNA, 21 bp, Artificial Sequence
  Synthetic Construct
ggggatccacatggtgaatgt

SEQ ID NO: 29821 - DNA, 22 bp, Artificial Sequence
  Synthetic Construct
tccaccagtcagccaagactca

SEQ ID NO: 29822 - DNA, 21 bp, Artificial Sequence
  Synthetic Construct
tcccaactgcttgttgaggtt

SEQ ID NO: 29823 - DNA, 23 bp, Artificial Sequence
  Synthetic Construct
ggaagccatgactaggctacagt

SEQ ID NO: 29824 - DNA, 22 bp, Artificial Sequence
  Synthetic Construct
cgcaggcatgtctccgttatag

SEQ ID NO: 29825 - DNA, 20 bp, Artificial Sequence
  Synthetic Construct
ccaatgccagggacacttct

SEQ ID NO: 29826 - DNA, 25 bp, Artificial Sequence
  Synthetic Construct
ctagctgttcctccaaagagtaagt

SEQ ID NO: 29827 - DNA, 25 bp, Artificial Sequence
  Synthetic Construct
ggtgattgtatgggaagcggaatct

SEQ ID NO: 29828 - DNA, 23 bp, Artificial Sequence
  Synthetic Construct
cacaattgcctctttggcagttc

SEQ ID NO: 29829 - DNA, 22 bp, Artificial Sequence
  Synthetic Construct
ccaccttgcccagtgaagaagt

SEQ ID NO: 29830 - DNA, 21 bp, Artificial Sequence
  Synthetic Construct
tgcaacctggtagctcagagt

SEQ ID NO: 29831 - DNA, 24 bp, Artificial Sequence
  Synthetic Construct
ggtagatcagccttcactgtgtgt

SEQ ID NO: 29832 - DNA, 20 bp, Artificial Sequence
  Synthetic Construct
gcaccatggcaggtccagaa

SEQ ID NO: 29833 - DNA, 20 bp, Artificial Sequence
  Synthetic Construct
ggtggtgcaaactggtgcta

SEQ ID NO: 29834 - DNA, 22 bp, Artificial Sequence
  Synthetic Construct
cctgcctttgccatgtccagat

SEQ ID NO: 29835 - DNA, 25 bp, Artificial Sequence
  Synthetic Construct
gtgtttctcacaatgttcggtgctt

SEQ ID NO: 29836 - DNA, 23 bp, Artificial Sequence
  Synthetic Construct
cccagtgcaaggaaagggtaatg

SEQ ID NO: 29837 - DNA, 23 bp, Artificial Sequence
  Synthetic Construct
accttgcacatagttgcatgttg

SEQ ID NO: 29838 - DNA, 22 bp, Artificial Sequence
  Synthetic Construct
gaggaagcaagggagctgtact

SEQ ID NO: 29839 - DNA, 25 bp, Artificial Sequence
  Synthetic Construct
gctaggttactgtatgcccttgaac

SEQ ID NO: 29840 - DNA, 27 bp, Artificial Sequence
  Synthetic Construct
gaccttttcactaacactggtgagact

SEQ ID NO: 29841 - DNA, 21 bp, Artificial Sequence
  Synthetic Construct
gcctttccagctctctgttct

SEQ ID NO: 29842 - DNA, 23 bp, Artificial Sequence
  Synthetic Construct
tgtgcagttagaagggagacaag

SEQ ID NO: 29843 - DNA, 24 bp, Artificial Sequence
  Synthetic Construct
catcctgttttctccctccattca

SEQ ID NO: 29844 - DNA, 25 bp, Artificial Sequence
  Synthetic Construct
tggtgaggtatagtggaagttcagt

SEQ ID NO: 29845 - DNA, 26 bp, Artificial Sequence
  Synthetic Construct
ggtatctggagaatgacttgttccaa

SEQ ID NO: 29846 - DNA, 24 bp, Artificial Sequence
  Synthetic Construct
gcttcggtaatgcttcaggtgtga

SEQ ID NO: 29847 - DNA, 20 bp, Artificial Sequence
  Synthetic Construct
gcgccagggacaatttcaga

SEQ ID NO: 29848 - DNA, 21 bp, Artificial Sequence
  Synthetic Construct
gcctgtcagtcacatgcttct

SEQ ID NO: 29849 - DNA, 25 bp, Artificial Sequence
  Synthetic Construct
ggacaatgatggagaaatccctgta

SEQ ID NO: 29850 - DNA, 27 bp, Artificial Sequence
  Synthetic Construct
ggcccaaataacaggaagtgccataat

SEQ ID NO: 29851 - DNA, 21 bp, Artificial Sequence
  Synthetic Construct
ttgggctcgtggtctgcttct

SEQ ID NO: 29852 - DNA, 28 bp, Artificial Sequence
  Synthetic Construct
ggctagtgacagaagtgttcctataatg

SEQ ID NO: 29853 - DNA, 25 bp, Artificial Sequence
  Synthetic Construct
gagggttcaaactgacagcaggatt

SEQ ID NO: 29854 - DNA, 21 bp, Artificial Sequence
  Synthetic Construct
gggctccaaaagcaacacact

SEQ ID NO: 29855 - DNA, 23 bp, Artificial Sequence
  Synthetic Construct
tccacaggctaagggtagaagaa

SEQ ID NO: 29856 - DNA, 25 bp, Artificial Sequence
  Synthetic Construct
ctgagcatcaagcttgtccttcttc

SEQ ID NO: 29857 - DNA, 25 bp, Artificial Sequence
  Synthetic Construct
ccaggctgggacctaatttcagcta

SEQ ID NO: 29858 - DNA, 24 bp, Artificial Sequence
  Synthetic Construct
gagagacctgagaaaccccgaatc

SEQ ID NO: 29859 - DNA, 21 bp, Artificial Sequence
  Synthetic Construct
agctgagagcagtctctggat

SEQ ID NO: 29860 - DNA, 27 bp, Artificial Sequence
  Synthetic Construct
ggttgtagtcatgataactgtgtgcat

SEQ ID NO: 29861 - DNA, 20 bp, Artificial Sequence
  Synthetic Construct
aggagcaaggcgcaagcaat

SEQ ID NO: 29862 - DNA, 25 bp, Artificial Sequence
  Synthetic Construct
ctcagagaataagaggtggctttca

SEQ ID NO: 29863 - DNA, 24 bp, Artificial Sequence
  Synthetic Construct
ctctgacctcagacatgcaggatt

SEQ ID NO: 29864 - DNA, 26 bp, Artificial Sequence
  Synthetic Construct
ggcagacaggatattttaacgcttgt

SEQ ID NO: 29865 - DNA, 23 bp, Artificial Sequence
  Synthetic Construct
gcagaacccctacaaagaaggta

SEQ ID NO: 29866 - DNA, 28 bp, Artificial Sequence
  Synthetic Construct
gctaatgactggacagagatttccttag

SEQ ID NO: 29867 - DNA, 23 bp, Artificial Sequence
  Synthetic Construct
gcttagcgtggtttaggcgaatg

SEQ ID NO: 29868 - DNA, 23 bp, Artificial Sequence
  Synthetic Construct
tccatggggagtgaagtgatctt

SEQ ID NO: 29869 - DNA, 26 bp, Artificial Sequence
  Synthetic Construct
gatgaagtggggatggttgcaataaa

SEQ ID NO: 29870 - DNA, 25 bp, Artificial Sequence
  Synthetic Construct
cccagtctctctgtctgttttcaag

SEQ ID NO: 29871 - DNA, 23 bp, Artificial Sequence
  Synthetic Construct
ggtctgaaggccgtatcagttct

SEQ ID NO: 29872 - DNA, 26 bp, Artificial Sequence
  Synthetic Construct
ccagcaagtttgcacaagacatttca

SEQ ID NO: 29873 - DNA, 22 bp, Artificial Sequence
  Synthetic Construct
ccctctctagctccttcacaca

SEQ ID NO: 29874 - DNA, 24 bp, Artificial Sequence
  Synthetic Construct
gagtgaaccttgccttacctttct

SEQ ID NO: 29875 - DNA, 22 bp, Artificial Sequence
  Synthetic Construct
gagggcgaaggggaagttttgt

SEQ ID NO: 29876 - DNA, 22 bp, Artificial Sequence
  Synthetic Construct
cagagtgccatgcattgtggta

SEQ ID NO: 29877 - DNA, 22 bp, Artificial Sequence
  Synthetic Construct
gtccacctcccatgggtcataa

SEQ ID NO: 29878 - DNA, 25 bp, Artificial Sequence
  Synthetic Construct
cctgaaagggttaatcagcttccat

SEQ ID NO: 29879 - DNA, 24 bp, Artificial Sequence
  Synthetic Construct
ggactagcagatggaacaaacaca

SEQ ID NO: 29880 - DNA, 25 bp, Artificial Sequence
  Synthetic Construct
ggtgattatgggcagccatacattg

SEQ ID NO: 29881 - DNA, 25 bp, Artificial Sequence
  Synthetic Construct
agaatgtcacagaagagggagaaac

SEQ ID NO: 29882 - DNA, 26 bp, Artificial Sequence
  Synthetic Construct
ctgtttccctcaaccaagacagaaca

SEQ ID NO: 29883 - DNA, 22 bp, Artificial Sequence
  Synthetic Construct
tccaggtccctgttggagatgt

SEQ ID NO: 29884 - DNA, 22 bp, Artificial Sequence
  Synthetic Construct
ccactgccccatttttcacatc

SEQ ID NO: 29885 - DNA, 22 bp, Artificial Sequence
  Synthetic Construct
gcttgtcaacaaagccggaaca

SEQ ID NO: 29886 - DNA, 24 bp, Artificial Sequence
  Synthetic Construct
tgtaacaagggccatgaagacaag

SEQ ID NO: 29887 - DNA, 22 bp, Artificial Sequence
  Synthetic Construct
ccctccaccactggcatgtaaa

SEQ ID NO: 29888 - DNA, 22 bp, Artificial Sequence
  Synthetic Construct
gccactggctctatcccctaga

SEQ ID NO: 29889 - DNA, 23 bp, Artificial Sequence
  Synthetic Construct
caaatgtcagaccctggagaaca

SEQ ID NO: 29890 - DNA, 25 bp, Artificial Sequence
  Synthetic Construct
gtcactaactacaggtgagcagcaa

SEQ ID NO: 29891 - DNA, 20 bp, Artificial Sequence
  Synthetic Construct
gcatgcctgcaggagagatt

SEQ ID NO: 29892 - DNA, 27 bp, Artificial Sequence
  Synthetic Construct
caagctctgctattagaggaatctgaa

SEQ ID NO: 29893 - DNA, 24 bp, Artificial Sequence
  Synthetic Construct
ctctgggcagggaatctctgaaag

SEQ ID NO: 29894 - DNA, 24 bp, Artificial Sequence
  Synthetic Construct
gcacggtaagaaaatgaggcttag

SEQ ID NO: 29895 - DNA, 27 bp, Artificial Sequence
  Synthetic Construct
ccttggatttcaaagccttctgatctt

SEQ ID NO: 29896 - DNA, 24 bp, Artificial Sequence
  Synthetic Construct
aggacacaggctaaaatcacaaca

SEQ ID NO: 29897 - DNA, 23 bp, Artificial Sequence
  Synthetic Construct
gcttgagcgctgagtgcttcatt

SEQ ID NO: 29898 - DNA, 28 bp, Artificial Sequence
  Synthetic Construct
cccatgtgtctggaaaccaatgacataa

SEQ ID NO: 29899 - DNA, 22 bp, Artificial Sequence
  Synthetic Construct
ggaccacacaaatcctgtgact

SEQ ID NO: 29900 - DNA, 24 bp, Artificial Sequence
  Synthetic Construct
aactagagcttcccaggagaaaag

SEQ ID NO: 29901 - DNA, 21 bp, Artificial Sequence
  Synthetic Construct
agcctagtctcccaactgcaa

SEQ ID NO: 29902 - DNA, 21 bp, Artificial Sequence
  Synthetic Construct
tgcctggaggggaggagtatc

SEQ ID NO: 29903 - DNA, 22 bp, Artificial Sequence
  Synthetic Construct
ggccaccaagtccactgagaaa

SEQ ID NO: 29904 - DNA, 25 bp, Artificial Sequence
  Synthetic Construct
caggtgttcagcaaattcctctttg

SEQ ID NO: 29905 - DNA, 22 bp, Artificial Sequence
  Synthetic Construct
cctggcgtcgatatcacggttt

SEQ ID NO: 29906 - DNA, 24 bp, Artificial Sequence
  Synthetic Construct
agaggctctgtagagttcagactt

SEQ ID NO: 29907 - DNA, 23 bp, Artificial Sequence
  Synthetic Construct
agggtgaggtaccatctttccat

SEQ ID NO: 29908 - DNA, 23 bp, Artificial Sequence
  Synthetic Construct
cctcatggccagtttttctcctt

SEQ ID NO: 29909 - DNA, 19 bp, Artificial Sequence
  Synthetic Construct
gcaaggcgcctccgtaaga

SEQ ID NO: 29910 - DNA, 28 bp, Artificial Sequence
  Synthetic Construct
gagatactccaaagctctttccttctac

SEQ ID NO: 29911 - DNA, 20 bp, Artificial Sequence
  Synthetic Construct
agagcagcgtggagaagtga

SEQ ID NO: 29912 - DNA, 25 bp, Artificial Sequence
  Synthetic Construct
agagaaacctgttgtgctcttactt

SEQ ID NO: 29913 - DNA, 25 bp, Artificial Sequence
  Synthetic Construct
ggaatgctcccactgaatgatgaac

SEQ ID NO: 29914 - DNA, 21 bp, Artificial Sequence
  Synthetic Construct
gccatccaagcagtcttgaca

SEQ ID NO: 29915 - DNA, 22 bp, Artificial Sequence
  Synthetic Construct
gtggtgtgttccgctacctagt

SEQ ID NO: 29916 - DNA, 25 bp, Artificial Sequence
  Synthetic Construct
gactacaggattcggagagggaaac

SEQ ID NO: 29917 - DNA, 24 bp, Artificial Sequence
  Synthetic Construct
agaatcaaggtggcttcagacttc

SEQ ID NO: 29918 - DNA, 22 bp, Artificial Sequence
  Synthetic Construct
ccagtgcctggctaagtgtcaa

SEQ ID NO: 29919 - DNA, 21 bp, Artificial Sequence
  Synthetic Construct
tccttccctccacgggattct

SEQ ID NO: 29920 - DNA, 22 bp, Artificial Sequence
  Synthetic Construct
ccccacaggtccctaagatgat

SEQ ID NO: 29921 - DNA, 22 bp, Artificial Sequence
  Synthetic Construct
gggcctgtctgcaatctctttg

SEQ ID NO: 29922 - DNA, 22 bp, Artificial Sequence
  Synthetic Construct
ccctgtcaccagcaggttcaaa

SEQ ID NO: 29923 - DNA, 22 bp, Artificial Sequence
  Synthetic Construct
ctctgaggacagacacggtaag

SEQ ID NO: 29924 - DNA, 22 bp, Artificial Sequence
  Synthetic Construct
cctgacagcctacgtgcaaaag

SEQ ID NO: 29925 - DNA, 24 bp, Artificial Sequence
  Synthetic Construct
gctgagaaacctcgaccttctatg

SEQ ID NO: 29926 - DNA, 22 bp, Artificial Sequence
  Synthetic Construct
ggtctatgcatgctaggcaact

SEQ ID NO: 29927 - DNA, 24 bp, Artificial Sequence
  Synthetic Construct
gatgccaattgaacacggaagtct

SEQ ID NO: 29928 - DNA, 24 bp, Artificial Sequence
  Synthetic Construct
ctgagagcagttaccttcctcttt

SEQ ID NO: 29929 - DNA, 21 bp, Artificial Sequence
  Synthetic Construct
gacctcgccactttcttggat

SEQ ID NO: 29930 - DNA, 26 bp, Artificial Sequence
  Synthetic Construct
cagtgtccatctgtgaacttctatct

SEQ ID NO: 29931 - DNA, 19 bp, Artificial Sequence
  Synthetic Construct
ttgcttggtgcgcccatct

SEQ ID NO: 29932 - DNA, 26 bp, Artificial Sequence
  Synthetic Construct
gttagagctggaacagactttagaga

SEQ ID NO: 29933 - DNA, 23 bp, Artificial Sequence
  Synthetic Construct
cagcatcgactgtgatggtttac

SEQ ID NO: 29934 - DNA, 23 bp, Artificial Sequence
  Synthetic Construct
gtcatttccttaggtgggtgcaa

SEQ ID NO: 29935 - DNA, 21 bp, Artificial Sequence
  Synthetic Construct
cacgtgacccagtggaaaaac

SEQ ID NO: 29936 - DNA, 20 bp, Artificial Sequence
  Synthetic Construct
aagcacggggctgagaagat

SEQ ID NO: 29937 - DNA, 24 bp, Artificial Sequence
  Synthetic Construct
tgtgacaagaaacatgggtacagt

SEQ ID NO: 29938 - DNA, 26 bp, Artificial Sequence
  Synthetic Construct
gggaagagctaggattttccccatct

SEQ ID NO: 29939 - DNA, 19 bp, Artificial Sequence
  Synthetic Construct
gggcagccaccttgtgaac

SEQ ID NO: 29940 - DNA, 21 bp, Artificial Sequence
  Synthetic Construct
acgtaggagctccacaaccta

SEQ ID NO: 29941 - DNA, 23 bp, Artificial Sequence
  Synthetic Construct
tctcccagttcagaccaagttga

SEQ ID NO: 29942 - DNA, 26 bp, Artificial Sequence
  Synthetic Construct
cagtcggagtaagtttcctcaacgat

SEQ ID NO: 29943 - DNA, 23 bp, Artificial Sequence
  Synthetic Construct
caaaccagtccttccaagcctta

SEQ ID NO: 29944 - DNA, 24 bp, Artificial Sequence
  Synthetic Construct
gtggctcaacacggtagatgtttg

SEQ ID NO: 29945 - DNA, 25 bp, Artificial Sequence
  Synthetic Construct
ccccattcacatctctgctcttttc

SEQ ID NO: 29946 - DNA, 24 bp, Artificial Sequence
  Synthetic Construct
ccgtgtgttgtgagcatgaaggtt

SEQ ID NO: 29947 - DNA, 21 bp, Artificial Sequence
  Synthetic Construct
caggttactcacccacagcat

SEQ ID NO: 29948 - DNA, 21 bp, Artificial Sequence
  Synthetic Construct
gtgaccacccacatcatcaca

SEQ ID NO: 29949 - DNA, 25 bp, Artificial Sequence
  Synthetic Construct
cagtagaaggtacagtccccaaaag

SEQ ID NO: 29950 - DNA, 23 bp, Artificial Sequence
  Synthetic Construct
ggagtgactgcttctgcttgaga

SEQ ID NO: 29951 - DNA, 23 bp, Artificial Sequence
  Synthetic Construct
ggagagaagtaggagtgggacat

SEQ ID NO: 29952 - DNA, 24 bp, Artificial Sequence
  Synthetic Construct
gctgtcaaaagtggatttcaccat

SEQ ID NO: 29953 - DNA, 21 bp, Artificial Sequence
  Synthetic Construct
tccctggacaccacgatctca

SEQ ID NO: 29954 - DNA, 21 bp, Artificial Sequence
  Synthetic Construct
ccaagccctcgttctgaaagt

SEQ ID NO: 29955 - DNA, 23 bp, Artificial Sequence
  Synthetic Construct
gggttggttagtcttggggaaca

SEQ ID NO: 29956 - DNA, 25 bp, Artificial Sequence
  Synthetic Construct
cacagaagagagggtatgaatgtga

SEQ ID NO: 29957 - DNA, 24 bp, Artificial Sequence
  Synthetic Construct
ctttgcctttgctaatgtccatgt

SEQ ID NO: 29958 - DNA, 23 bp, Artificial Sequence
  Synthetic Construct
tggacagtgcagctctacacata

SEQ ID NO: 29959 - DNA, 22 bp, Artificial Sequence
  Synthetic Construct
cacacatcccgcgaggggaatc

SEQ ID NO: 29960 - DNA, 24 bp, Artificial Sequence
  Synthetic Construct
gcattgaacaggctcttccctaga

SEQ ID NO: 29961 - DNA, 24 bp, Artificial Sequence
  Synthetic Construct
gttgctgtgaacacctgcatgaaa

SEQ ID NO: 29962 - DNA, 27 bp, Artificial Sequence
  Synthetic Construct
ggctgaaaatatttcctccatggtgtt

SEQ ID NO: 29963 - DNA, 21 bp, Artificial Sequence
  Synthetic Construct
gcatctccacacctccactga

SEQ ID NO: 29964 - DNA, 24 bp, Artificial Sequence
  Synthetic Construct
ggccatcatagaccattcatgcta

SEQ ID NO: 29965 - DNA, 22 bp, Artificial Sequence
  Synthetic Construct
gcagatggacgtgatgggtaga

SEQ ID NO: 29966 - DNA, 22 bp, Artificial Sequence
  Synthetic Construct
ccccacagcattcccagtctac

SEQ ID NO: 29967 - DNA, 23 bp, Artificial Sequence
  Synthetic Construct
ggacagccctctgttgtttctaa

SEQ ID NO: 29968 - DNA, 24 bp, Artificial Sequence
  Synthetic Construct
gcagaagtgggagaagtctgtgtt

SEQ ID NO: 29969 - DNA, 23 bp, Artificial Sequence
  Synthetic Construct
ctgtcaacagggctttcaagcta

SEQ ID NO: 29970 - DNA, 26 bp, Artificial Sequence
  Synthetic Construct
ccccaacacccatgtatttgtagtga

SEQ ID NO: 29971 - DNA, 24 bp, Artificial Sequence
  Synthetic Construct
cgccagtccacatcagaacacatt

SEQ ID NO: 29972 - DNA, 26 bp, Artificial Sequence
  Synthetic Construct
ccctagctaaaggacactccttatca

SEQ ID NO: 29973 - DNA, 25 bp, Artificial Sequence
  Synthetic Construct
caaggaaggtcaagtcttcctcagt

SEQ ID NO: 29974 - DNA, 22 bp, Artificial Sequence
  Synthetic Construct
ggctgggcagagccagataata

SEQ ID NO: 29975 - DNA, 25 bp, Artificial Sequence
  Synthetic Construct
aggttctggcaagtggaaataaaag

SEQ ID NO: 29976 - DNA, 24 bp, Artificial Sequence
  Synthetic Construct
gccagggtcggtaactgatgtatg

SEQ ID NO: 29977 - DNA, 21 bp, Artificial Sequence
  Synthetic Construct
ggccccatgctgaacagaaaa

SEQ ID NO: 29978 - DNA, 23 bp, Artificial Sequence
  Synthetic Construct
aggaccagctttagtgtctgatg

SEQ ID NO: 29979 - DNA, 26 bp, Artificial Sequence
  Synthetic Construct
gctggtcaaaagcatcttgcaaaaca

SEQ ID NO: 29980 - DNA, 24 bp, Artificial Sequence
  Synthetic Construct
gaggaaattagtctggctgaggtt

SEQ ID NO: 29981 - DNA, 24 bp, Artificial Sequence
  Synthetic Construct
gctgtaagagcctggatacgagtt

SEQ ID NO: 29982 - DNA, 25 bp, Artificial Sequence
  Synthetic Construct
catgttcctacatgtctcagagcaa

SEQ ID NO: 29983 - DNA, 29 bp, Artificial Sequence
  Synthetic Construct
cccagaccaaagtcttaacattcccttta

SEQ ID NO: 29984 - DNA, 22 bp, Artificial Sequence
  Synthetic Construct
ctgcaaaggggaccttccaagt

SEQ ID NO: 29985 - DNA, 22 bp, Artificial Sequence
  Synthetic Construct
gcccaggtggatagtcaagaca

SEQ ID NO: 29986 - DNA, 30 bp, Artificial Sequence
  Synthetic Construct
gactgaaaaagtttggaaagcatggctcta

SEQ ID NO: 29987 - DNA, 30 bp, Artificial Sequence
  Synthetic Construct
gggcatctgtgtatatagttcccaagtcta

SEQ ID NO: 29988 - DNA, 24 bp, Artificial Sequence
  Synthetic Construct
tctcacgggaatcaccatcatttt

SEQ ID NO: 29989 - DNA, 21 bp, Artificial Sequence
  Synthetic Construct
gggctgaagcaaagaccatgt

SEQ ID NO: 29990 - DNA, 25 bp, Artificial Sequence
  Synthetic Construct
cctggcttagcaagaatttgtttgt

SEQ ID NO: 29991 - DNA, 21 bp, Artificial Sequence
  Synthetic Construct
tgggtgggagtgcctgtaaac

SEQ ID NO: 29992 - DNA, 24 bp, Artificial Sequence
  Synthetic Construct
actaatgatgtgacccacccaatc

SEQ ID NO: 29993 - DNA, 22 bp, Artificial Sequence
  Synthetic Construct
gaccccgttgcctactaacaga

SEQ ID NO: 29994 - DNA, 25 bp, Artificial Sequence
  Synthetic Construct
ctgtccaccactacctcgtatctca

SEQ ID NO: 29995 - DNA, 22 bp, Artificial Sequence
  Synthetic Construct
cagttacgctcactggatggat

SEQ ID NO: 29996 - DNA, 23 bp, Artificial Sequence
  Synthetic Construct
aaaaatgaggctctgggaagtca

SEQ ID NO: 29997 - DNA, 25 bp, Artificial Sequence
  Synthetic Construct
ccaccctttctgaacttaggcatgt

SEQ ID NO: 29998 - DNA, 23 bp, Artificial Sequence
  Synthetic Construct
cataggaattgccggagacatga

SEQ ID NO: 29999 - DNA, 24 bp, Artificial Sequence
  Synthetic Construct
gcatttgtggctctagggtaaaac

SEQ ID NO: 30000 - DNA, 20 bp, Artificial Sequence
  Synthetic Construct
tccctggcaattccccttca

SEQ ID NO: 30001 - DNA, 22 bp, Artificial Sequence
  Synthetic Construct
ggccacaggtttctctgcttca

SEQ ID NO: 30002 - DNA, 22 bp, Artificial Sequence
  Synthetic Construct
gagtgggagcatggatggtgat

SEQ ID NO: 30003 - DNA, 27 bp, Artificial Sequence
  Synthetic Construct
ggaaatcctgctacatttcgctagtta

SEQ ID NO: 30004 - DNA, 24 bp, Artificial Sequence
  Synthetic Construct
gcagggacttaatgagggcaattt

SEQ ID NO: 30005 - DNA, 23 bp, Artificial Sequence
  Synthetic Construct
actcctagtcacttgcacagtct

SEQ ID NO: 30006 - DNA, 24 bp, Artificial Sequence
  Synthetic Construct
gactagtgtgtctgctttgcgttt

SEQ ID NO: 30007 - DNA, 26 bp, Artificial Sequence
  Synthetic Construct
gttttagccagaggctctatatccat

SEQ ID NO: 30008 - DNA, 23 bp, Artificial Sequence
  Synthetic Construct
ctgctacctacagccagacttca

SEQ ID NO: 30009 - DNA, 25 bp, Artificial Sequence
  Synthetic Construct
gctgttattttagctcttgctggtt

SEQ ID NO: 30010 - DNA, 25 bp, Artificial Sequence
  Synthetic Construct
ggtgaagcttgtgttaagggttcaa

SEQ ID NO: 30011 - DNA, 22 bp, Artificial Sequence
  Synthetic Construct
aggggcctcctgaggaaatact

SEQ ID NO: 30012 - DNA, 21 bp, Artificial Sequence
  Synthetic Construct
ggaacacccgagccattctga

SEQ ID NO: 30013 - DNA, 23 bp, Artificial Sequence
  Synthetic Construct
gctacctgggctgtggtatcttc

SEQ ID NO: 30014 - DNA, 26 bp, Artificial Sequence
  Synthetic Construct
tctccatgacttccctctgttatttc

SEQ ID NO: 30015 - DNA, 24 bp, Artificial Sequence
  Synthetic Construct
cctctgctttgacttgcttcaaat

SEQ ID NO: 30016 - DNA, 27 bp, Artificial Sequence
  Synthetic Construct
gcttctctaccacatagtgtaatggtt

SEQ ID NO: 30017 - DNA, 20 bp, Artificial Sequence
  Synthetic Construct
aggaacctggccccttctct

SEQ ID NO: 30018 - DNA, 21 bp, Artificial Sequence
  Synthetic Construct
tgaagccccagtcctacttga

SEQ ID NO: 30019 - DNA, 24 bp, Artificial Sequence
  Synthetic Construct
aagctgagaaaaacagccatcttc

SEQ ID NO: 30020 - DNA, 26 bp, Artificial Sequence
  Synthetic Construct
ggcgtacactatgggaaggtaagttg

SEQ ID NO: 30021 - DNA, 24 bp, Artificial Sequence
  Synthetic Construct
cagggtggacctctctgagatatt

SEQ ID NO: 30022 - DNA, 22 bp, Artificial Sequence
  Synthetic Construct
gctgctgctaattcaccctgta

SEQ ID NO: 30023 - DNA, 27 bp, Artificial Sequence
  Synthetic Construct
ctcatgaaaattgtgccgattgctaag

SEQ ID NO: 30024 - DNA, 21 bp, Artificial Sequence
  Synthetic Construct
cagtggtcagggacagctcta

SEQ ID NO: 30025 - DNA, 22 bp, Artificial Sequence
  Synthetic Construct
ggcctggccactttagtactct

SEQ ID NO: 30026 - DNA, 22 bp, Artificial Sequence
  Synthetic Construct
cctgagatgaggatgggagcat

SEQ ID NO: 30027 - DNA, 22 bp, Artificial Sequence
  Synthetic Construct
gcagactgaccctgtgactttc

SEQ ID NO: 30028 - DNA, 24 bp, Artificial Sequence
  Synthetic Construct
tgaagaaagcatctggcatgtgaa

SEQ ID NO: 30029 - DNA, 24 bp, Artificial Sequence
  Synthetic Construct
ggggagagtgagtctaggttctgt

SEQ ID NO: 30030 - DNA, 30 bp, Artificial Sequence
  Synthetic Construct
gcgatagacacttttatccagctttacaca

SEQ ID NO: 30031 - DNA, 23 bp, Artificial Sequence
  Synthetic Construct
ggggttgagctggtttgatatgt

SEQ ID NO: 30032 - DNA, 25 bp, Artificial Sequence
  Synthetic Construct
gctgtgtctaggctttttcgtgata

SEQ ID NO: 30033 - DNA, 19 bp, Artificial Sequence
  Synthetic Construct
agacggactcccggcgttt

SEQ ID NO: 30034 - DNA, 23 bp, Artificial Sequence
  Synthetic Construct
cagttcacctgtctgctgaggaa

SEQ ID NO: 30035 - DNA, 27 bp, Artificial Sequence
  Synthetic Construct
ccagaagtctcagaaaaggaaccatac

SEQ ID NO: 30036 - DNA, 24 bp, Artificial Sequence
  Synthetic Construct
ccacagtgggcagctattctccat

SEQ ID NO: 30037 - DNA, 25 bp, Artificial Sequence
  Synthetic Construct
tccataaggtggtcccttgattaac

SEQ ID NO: 30038 - DNA, 26 bp, Artificial Sequence
  Synthetic Construct
cagccaactcgtaggttcaaacaatg

SEQ ID NO: 30039 - DNA, 25 bp, Artificial Sequence
  Synthetic Construct
cctcctgaagctcagaatacaccaa

SEQ ID NO: 30040 - DNA, 21 bp, Artificial Sequence
  Synthetic Construct
ttcggaagctgtgcatgatga

SEQ ID NO: 30041 - DNA, 27 bp, Artificial Sequence
  Synthetic Construct
cccctcagtaattttacctgggattag

SEQ ID NO: 30042 - DNA, 19 bp, Artificial Sequence
  Synthetic Construct
cggggcgcaggctagaaaa

SEQ ID NO: 30043 - DNA, 25 bp, Artificial Sequence
  Synthetic Construct
tccacggaatcagaggatagtaagt

SEQ ID NO: 30044 - DNA, 22 bp, Artificial Sequence
  Synthetic Construct
ctgcaatgtgttggctgggaat

SEQ ID NO: 30045 - DNA, 25 bp, Artificial Sequence
  Synthetic Construct
cagagccttgattggacaaccctta

SEQ ID NO: 30046 - DNA, 24 bp, Artificial Sequence
  Synthetic Construct
cagaacccactgctctatgagtgt

SEQ ID NO: 30047 - DNA, 23 bp, Artificial Sequence
  Synthetic Construct
agtccaccatcaggaacagtaga

SEQ ID NO: 30048 - DNA, 27 bp, Artificial Sequence
  Synthetic Construct
ctatcgagatattggggaagagcttta

SEQ ID NO: 30049 - DNA, 29 bp, Artificial Sequence
  Synthetic Construct
gcagctctggtagataaggccatacatta

SEQ ID NO: 30050 - DNA, 22 bp, Artificial Sequence
  Synthetic Construct
ggagggaatgggcgttttcaac

SEQ ID NO: 30051 - DNA, 26 bp, Artificial Sequence
  Synthetic Construct
acttctcaaggacaagtgttctcttc

SEQ ID NO: 30052 - DNA, 27 bp, Artificial Sequence
  Synthetic Construct
ctcttgaccacatctggaagtagaaac

SEQ ID NO: 30053 - DNA, 25 bp, Artificial Sequence
  Synthetic Construct
gaccaaggaaaggttggctaatagt

SEQ ID NO: 30054 - DNA, 23 bp, Artificial Sequence
  Synthetic Construct
gcctccatttcttgctggttgtt

SEQ ID NO: 30055 - DNA, 22 bp, Artificial Sequence
  Synthetic Construct
agcttctcccagatgccctact

SEQ ID NO: 30056 - DNA, 21 bp, Artificial Sequence
  Synthetic Construct
tgtggcagggacagaggttct

SEQ ID NO: 30057 - DNA, 23 bp, Artificial Sequence
  Synthetic Construct
ggctcctaggggtggtagattgt

SEQ ID NO: 30058 - DNA, 27 bp, Artificial Sequence
  Synthetic Construct
cctcatccttagtggggagtaacagat

SEQ ID NO: 30059 - DNA, 22 bp, Artificial Sequence
  Synthetic Construct
tctcatctcgagacacccagaa

SEQ ID NO: 30060 - DNA, 26 bp, Artificial Sequence
  Synthetic Construct
gcatgtatacttgaagcccacacaga

SEQ ID NO: 30061 - DNA, 20 bp, Artificial Sequence
  Synthetic Construct
aggccatggctcttctcctt

SEQ ID NO: 30062 - DNA, 26 bp, Artificial Sequence
  Synthetic Construct
gtgagatggtatctaggtcactgctt

SEQ ID NO: 30063 - DNA, 27 bp, Artificial Sequence
  Synthetic Construct
ccaattgctatagccaaaagccataca

SEQ ID NO: 30064 - DNA, 23 bp, Artificial Sequence
  Synthetic Construct
gctctgttcttcaggtgggaaag

SEQ ID NO: 30065 - DNA, 22 bp, Artificial Sequence
  Synthetic Construct
ccgtgatgctggatcagccaat

SEQ ID NO: 30066 - DNA, 20 bp, Artificial Sequence
  Synthetic Construct
tctcagggccagccccactt

SEQ ID NO: 30067 - DNA, 23 bp, Artificial Sequence
  Synthetic Construct
gactgacgagaactgcaatgtgt

SEQ ID NO: 30068 - DNA, 24 bp, Artificial Sequence
  Synthetic Construct
ctggcttaagcaaaaggggaattt

SEQ ID NO: 30069 - DNA, 20 bp, Artificial Sequence
  Synthetic Construct
agctccctcctcatgctaca

SEQ ID NO: 30070 - DNA, 25 bp, Artificial Sequence
  Synthetic Construct
tctcgaagtaggaagatcccattct

SEQ ID NO: 30071 - DNA, 22 bp, Artificial Sequence
  Synthetic Construct
ccgctatgcctggcttaacttc

SEQ ID NO: 30072 - DNA, 26 bp, Artificial Sequence
  Synthetic Construct
cgtgtcatttagacagccctgttttc

SEQ ID NO: 30073 - DNA, 23 bp, Artificial Sequence
  Synthetic Construct
aggtgaccctatcttcagtgcta

SEQ ID NO: 30074 - DNA, 22 bp, Artificial Sequence
  Synthetic Construct
ccggtcagccaaaggtcttcta

SEQ ID NO: 30075 - DNA, 22 bp, Artificial Sequence
  Synthetic Construct
gggtttgagggtgtgggtttgt

SEQ ID NO: 30076 - DNA, 22 bp, Artificial Sequence
  Synthetic Construct
ccgcgtcggatgaacaagaaac

SEQ ID NO: 30077 - DNA, 21 bp, Artificial Sequence
  Synthetic Construct
cctccctccctatggctactt

SEQ ID NO: 30078 - DNA, 24 bp, Artificial Sequence
  Synthetic Construct
ggtgcatgatttgagaggaacgaa

SEQ ID NO: 30079 - DNA, 26 bp, Artificial Sequence
  Synthetic Construct
caccttttagctcagaagatgcagat

SEQ ID NO: 30080 - DNA, 24 bp, Artificial Sequence
  Synthetic Construct
caaggatatggaggaccaggattc

SEQ ID NO: 30081 - DNA, 23 bp, Artificial Sequence
  Synthetic Construct
ggtccatggtgttgagggaattg

SEQ ID NO: 30082 - DNA, 27 bp, Artificial Sequence
  Synthetic Construct
cagctaagggaaagtcaattcaggtta

SEQ ID NO: 30083 - DNA, 21 bp, Artificial Sequence
  Synthetic Construct
tgcacggggaaactcacattc

SEQ ID NO: 30084 - DNA, 24 bp, Artificial Sequence
  Synthetic Construct
tgaaacgataccgcccttaaaagt

SEQ ID NO: 30085 - DNA, 24 bp, Artificial Sequence
  Synthetic Construct
tgtcaccaaactttctgtgcatct

SEQ ID NO: 30086 - DNA, 21 bp, Artificial Sequence
  Synthetic Construct
ccaaaaggagcatggctgtct

SEQ ID NO: 30087 - DNA, 22 bp, Artificial Sequence
  Synthetic Construct
aacgcctactttccctgtcttc

SEQ ID NO: 30088 - DNA, 20 bp, Artificial Sequence
  Synthetic Construct
gacaacacggctgtccacaa

SEQ ID NO: 30089 - DNA, 23 bp, Artificial Sequence
  Synthetic Construct
cgaatagtgctgggaatctctga

SEQ ID NO: 30090 - DNA, 29 bp, Artificial Sequence
  Synthetic Construct
gcttctgatccttggaacatttggttcat

SEQ ID NO: 30091 - DNA, 29 bp, Artificial Sequence
  Synthetic Construct
ccagtaaaccttttccatgaaagcctgaa

SEQ ID NO: 30092 - DNA, 24 bp, Artificial Sequence
  Synthetic Construct
tgattggctcccagaagttgtaat

SEQ ID NO: 30093 - DNA, 26 bp, Artificial Sequence
  Synthetic Construct
ctctgaaagatcgtgtcttcctttgt

SEQ ID NO: 30094 - DNA, 22 bp, Artificial Sequence
  Synthetic Construct
tgtcagcactgccttcaaaatg

SEQ ID NO: 30095 - DNA, 27 bp, Artificial Sequence
  Synthetic Construct
ccctaaaacatgcaacctttccttatc

SEQ ID NO: 30096 - DNA, 26 bp, Artificial Sequence
  Synthetic Construct
aacaaaggatacctccgggtaatatg

SEQ ID NO: 30097 - DNA, 25 bp, Artificial Sequence
  Synthetic Construct
gctcaaagaggattaggctgcttca

SEQ ID NO: 30098 - DNA, 21 bp, Artificial Sequence
  Synthetic Construct
cacctgcagactagcacaaga

SEQ ID NO: 30099 - DNA, 21 bp, Artificial Sequence
  Synthetic Construct
cttgcttcaggccaagcaaaa

SEQ ID NO: 30100 - DNA, 25 bp, Artificial Sequence
  Synthetic Construct
gtccataagggcatatgggtgtttc

SEQ ID NO: 30101 - DNA, 20 bp, Artificial Sequence
  Synthetic Construct
aaccgaggggagtcccagtt

SEQ ID NO: 30102 - DNA, 22 bp, Artificial Sequence
  Synthetic Construct
gccaccctggttcctcatcatt

SEQ ID NO: 30103 - DNA, 25 bp, Artificial Sequence
  Synthetic Construct
ggcaggtccttaagtgagtgactgt

SEQ ID NO: 30104 - DNA, 22 bp, Artificial Sequence
  Synthetic Construct
cagctcctctcctgtcccattt

SEQ ID NO: 30105 - DNA, 22 bp, Artificial Sequence
  Synthetic Construct
ggcgactcgacacctgaaaact

SEQ ID NO: 30106 - DNA, 22 bp, Artificial Sequence
  Synthetic Construct
tggggaaccttagagagcttgt

SEQ ID NO: 30107 - DNA, 22 bp, Artificial Sequence
  Synthetic Construct
gcaggtagacgtgattcagctt

SEQ ID NO: 30108 - DNA, 26 bp, Artificial Sequence
  Synthetic Construct
caggatagctccctaaggctcaaatg

SEQ ID NO: 30109 - DNA, 22 bp, Artificial Sequence
  Synthetic Construct
ctccagtgccatacccagttgt

SEQ ID NO: 30110 - DNA, 28 bp, Artificial Sequence
  Synthetic Construct
gctaaacaatggtgtagtcttgggatct

SEQ ID NO: 30111 - DNA, 23 bp, Artificial Sequence
  Synthetic Construct
gaggcaacagcagacatccatca

SEQ ID NO: 30112 - DNA, 25 bp, Artificial Sequence
  Synthetic Construct
tcggattccttgttctagacctttc

SEQ ID NO: 30113 - DNA, 22 bp, Artificial Sequence
  Synthetic Construct
aggctctgtccccatgacctaa

SEQ ID NO: 30114 - DNA, 21 bp, Artificial Sequence
  Synthetic Construct
atccgtgacaggccacacaac

SEQ ID NO: 30115 - DNA, 24 bp, Artificial Sequence
  Synthetic Construct
ccccagcagagaggagaccatatt

SEQ ID NO: 30116 - DNA, 26 bp, Artificial Sequence
  Synthetic Construct
gagatcaggacagaacaggtctaaag

SEQ ID NO: 30117 - DNA, 26 bp, Artificial Sequence
  Synthetic Construct
gagtacagtcagcctcttgtttcctt

SEQ ID NO: 30118 - DNA, 25 bp, Artificial Sequence
  Synthetic Construct
ccttcctcatcatggtagcatctca

SEQ ID NO: 30119 - DNA, 21 bp, Artificial Sequence
  Synthetic Construct
gcagagcagcattgacgaaca

SEQ ID NO: 30120 - DNA, 18 bp, Artificial Sequence
  Synthetic Construct
tagcggcaccctgtgctt

SEQ ID NO: 30121 - DNA, 20 bp, Artificial Sequence
  Synthetic Construct
agccatggtcccaggataca

SEQ ID NO: 30122 - DNA, 21 bp, Artificial Sequence
  Synthetic Construct
cgtgcaatccgtggtgaggaa

SEQ ID NO: 30123 - DNA, 20 bp, Artificial Sequence
  Synthetic Construct
agctggccgcattccagttt

SEQ ID NO: 30124 - DNA, 24 bp, Artificial Sequence
  Synthetic Construct
actgagattctcgccctgaaaatg

SEQ ID NO: 30125 - DNA, 30 bp, Artificial Sequence
  Synthetic Construct
gcagagaggttagttcactaatagaagcat

SEQ ID NO: 30126 - DNA, 22 bp, Artificial Sequence
  Synthetic Construct
ggccttcaaaaggcaggactgt

SEQ ID NO: 30127 - DNA, 24 bp, Artificial Sequence
  Synthetic Construct
ccttggaccagagactatgtggaa

SEQ ID NO: 30128 - DNA, 26 bp, Artificial Sequence
  Synthetic Construct
tccctgtctacatgaagcagataaag

SEQ ID NO: 30129 - DNA, 23 bp, Artificial Sequence
  Synthetic Construct
gccagaaatctgccctctaggtt

SEQ ID NO: 30130 - DNA, 23 bp, Artificial Sequence
  Synthetic Construct
ggacaggctccagatgctaacaa

SEQ ID NO: 30131 - DNA, 22 bp, Artificial Sequence
  Synthetic Construct
ctccccagacagagagaactga

SEQ ID NO: 30132 - DNA, 22 bp, Artificial Sequence
  Synthetic Construct
gtcacacacaggcatggctaca

SEQ ID NO: 30133 - DNA, 20 bp, Artificial Sequence
  Synthetic Construct
agggaggggcatctgcgtat

SEQ ID NO: 30134 - DNA, 24 bp, Artificial Sequence
  Synthetic Construct
cctttgcttttagcaggacacttg

SEQ ID NO: 30135 - DNA, 24 bp, Artificial Sequence
  Synthetic Construct
ctgggacaccagggaatgatgttc

SEQ ID NO: 30136 - DNA, 23 bp, Artificial Sequence
  Synthetic Construct
gaccatgtggcttgtgcaaagtt

SEQ ID NO: 30137 - DNA, 23 bp, Artificial Sequence
  Synthetic Construct
ggtcctgataggaaggcaaaagt

SEQ ID NO: 30138 - DNA, 21 bp, Artificial Sequence
  Synthetic Construct
agtgcccctcagcacatgaag

SEQ ID NO: 30139 - DNA, 20 bp, Artificial Sequence
  Synthetic Construct
ggtcgcctttggagcagaga

SEQ ID NO: 30140 - DNA, 22 bp, Artificial Sequence
  Synthetic Construct
cagacacggcatcttcctggat

SEQ ID NO: 30141 - DNA, 20 bp, Artificial Sequence
  Synthetic Construct
gctgcgtctttcctggatgt

SEQ ID NO: 30142 - DNA, 26 bp, Artificial Sequence
  Synthetic Construct
gccccagttatcacctaatgaacaca

SEQ ID NO: 30143 - DNA, 25 bp, Artificial Sequence
  Synthetic Construct
agtttgtctcccataagctctgtag

SEQ ID NO: 30144 - DNA, 27 bp, Artificial Sequence
  Synthetic Construct
ccacccttaaaaactcctctcatcaac

SEQ ID NO: 30145 - DNA, 28 bp, Artificial Sequence
  Synthetic Construct
ccacacttcaaggcttcaaatcatcctt

SEQ ID NO: 30146 - DNA, 22 bp, Artificial Sequence
  Synthetic Construct
cccggccacaaactgctttcta

SEQ ID NO: 30147 - DNA, 23 bp, Artificial Sequence
  Synthetic Construct
gatggagacccctctctccacta

SEQ ID NO: 30148 - DNA, 21 bp, Artificial Sequence
  Synthetic Construct
cccatttcccacccacaggaa

SEQ ID NO: 30149 - DNA, 23 bp, Artificial Sequence
  Synthetic Construct
ctcacagcctttctcagcctttc

SEQ ID NO: 30150 - DNA, 22 bp, Artificial Sequence
  Synthetic Construct
gctaggcttggtctctgcaact

SEQ ID NO: 30151 - DNA, 24 bp, Artificial Sequence
  Synthetic Construct
cacggttcatgtaaaagagcgaat

SEQ ID NO: 30152 - DNA, 20 bp, Artificial Sequence
  Synthetic Construct
tgtggcggacgccattatca

SEQ ID NO: 30153 - DNA, 20 bp, Artificial Sequence
  Synthetic Construct
gtttggtgctggctttggtt

SEQ ID NO: 30154 - DNA, 22 bp, Artificial Sequence
  Synthetic Construct
cagctccaggctgagacattca

SEQ ID NO: 30155 - DNA, 22 bp, Artificial Sequence
  Synthetic Construct
ccaggccaaccttagccatatt

SEQ ID NO: 30156 - DNA, 22 bp, Artificial Sequence
  Synthetic Construct
ggagatggagggagctttgtga

SEQ ID NO: 30157 - DNA, 27 bp, Artificial Sequence
  Synthetic Construct
gtcctgctttaggacttttgcacttac

SEQ ID NO: 30158 - DNA, 26 bp, Artificial Sequence
  Synthetic Construct
gaatggggttgtccacaattagtatg

SEQ ID NO: 30159 - DNA, 22 bp, Artificial Sequence
  Synthetic Construct
ccaccaacccgatcagtgcaaa

SEQ ID NO: 30160 - DNA, 25 bp, Artificial Sequence
  Synthetic Construct
actttttcagcagctctcttcatct

SEQ ID NO: 30161 - DNA, 25 bp, Artificial Sequence
  Synthetic Construct
tcttccattctccccttccaaaatg

SEQ ID NO: 30162 - DNA, 24 bp, Artificial Sequence
  Synthetic Construct
gctgacagacttgctttcccagta

SEQ ID NO: 30163 - DNA, 20 bp, Artificial Sequence
  Synthetic Construct
gcaccaggttggatgtgcta

SEQ ID NO: 30164 - DNA, 26 bp, Artificial Sequence
  Synthetic Construct
tctgtgggtgtaaggaatacacaatg

SEQ ID NO: 30165 - DNA, 25 bp, Artificial Sequence
  Synthetic Construct
ctgaggctaaagatcacccatggta

SEQ ID NO: 30166 - DNA, 22 bp, Artificial Sequence
  Synthetic Construct
gctcctcacggatggtctgaaa

SEQ ID NO: 30167 - DNA, 24 bp, Artificial Sequence
  Synthetic Construct
ctcaccagcctgagaaaaggaaac

SEQ ID NO: 30168 - DNA, 23 bp, Artificial Sequence
  Synthetic Construct
cagggagtctgtcccttgcatac

SEQ ID NO: 30169 - DNA, 26 bp, Artificial Sequence
  Synthetic Construct
gcatcttagtcacagggaccagaaac

SEQ ID NO: 30170 - DNA, 20 bp, Artificial Sequence
  Synthetic Construct
tgggaagtggcgtgtgttca

SEQ ID NO: 30171 - DNA, 20 bp, Artificial Sequence
  Synthetic Construct
ccagtccaggcccctggtta

SEQ ID NO: 30172 - DNA, 23 bp, Artificial Sequence
  Synthetic Construct
gtggagggaatagccctttgaga

SEQ ID NO: 30173 - DNA, 22 bp, Artificial Sequence
  Synthetic Construct
ggccagtccccactctttctta

SEQ ID NO: 30174 - DNA, 23 bp, Artificial Sequence
  Synthetic Construct
gacagcagaatgcaagtgacctt

SEQ ID NO: 30175 - DNA, 25 bp, Artificial Sequence
  Synthetic Construct
ctgtttcttcgctggctacagtttg

SEQ ID NO: 30176 - DNA, 26 bp, Artificial Sequence
  Synthetic Construct
ctcccctggaaacaataagtcgatga

SEQ ID NO: 30177 - DNA, 25 bp, Artificial Sequence
  Synthetic Construct
tgtgcccaagaagtaaattgggata

SEQ ID NO: 30178 - DNA, 22 bp, Artificial Sequence
  Synthetic Construct
ggtgtggccttcacaggtaaga

SEQ ID NO: 30179 - DNA, 22 bp, Artificial Sequence
  Synthetic Construct
cctcaagagcatgctacacact

SEQ ID NO: 30180 - DNA, 21 bp, Artificial Sequence
  Synthetic Construct
tgctggacaccacagaacttt

SEQ ID NO: 30181 - DNA, 24 bp, Artificial Sequence
  Synthetic Construct
gtcaacattcacactcaggacctt

SEQ ID NO: 30182 - DNA, 24 bp, Artificial Sequence
  Synthetic Construct
tgtcttccattagctccagactca

SEQ ID NO: 30183 - DNA, 25 bp, Artificial Sequence
  Synthetic Construct
ccatcctcttcacgcccatcagata

SEQ ID NO: 30184 - DNA, 23 bp, Artificial Sequence
  Synthetic Construct
tgctcccttgctattgagacttg

SEQ ID NO: 30185 - DNA, 24 bp, Artificial Sequence
  Synthetic Construct
cccacactcactcctctagtctgt

SEQ ID NO: 30186 - DNA, 25 bp, Artificial Sequence
  Synthetic Construct
ggagaaaggttgagtctggggaatg

SEQ ID NO: 30187 - DNA, 26 bp, Artificial Sequence
  Synthetic Construct
ccacataccaaggagagttgacagat

SEQ ID NO: 30188 - DNA, 22 bp, Artificial Sequence
  Synthetic Construct
gacgtcatttagctcgggtgaa

SEQ ID NO: 30189 - DNA, 26 bp, Artificial Sequence
  Synthetic Construct
gcaaaagatcctgctctgtagggaaa

SEQ ID NO: 30190 - DNA, 27 bp, Artificial Sequence
  Synthetic Construct
ccctcgataaggcaatgtatactcaca

SEQ ID NO: 30191 - DNA, 28 bp, Artificial Sequence
  Synthetic Construct
gccccagaatatgaaattggaacagaag

SEQ ID NO: 30192 - DNA, 21 bp, Artificial Sequence
  Synthetic Construct
cagaatggatgcgtccgctaa

SEQ ID NO: 30193 - DNA, 24 bp, Artificial Sequence
  Synthetic Construct
gttcagggttcttcttctctccaa

SEQ ID NO: 30194 - DNA, 25 bp, Artificial Sequence
  Synthetic Construct
gatttcttaaagccggtttgtggat

SEQ ID NO: 30195 - DNA, 24 bp, Artificial Sequence
  Synthetic Construct
ccctatggaaagacagcacccaaa

SEQ ID NO: 30196 - DNA, 27 bp, Artificial Sequence
  Synthetic Construct
cctcctagttcctactcagcctctaac

SEQ ID NO: 30197 - DNA, 24 bp, Artificial Sequence
  Synthetic Construct
catgcctgaggtaacacctactct

SEQ ID NO: 30198 - DNA, 26 bp, Artificial Sequence
  Synthetic Construct
gtcttgtcattcctacccttcaaatg

SEQ ID NO: 30199 - DNA, 20 bp, Artificial Sequence
  Synthetic Construct
gcttcatgcctgccatcctt

SEQ ID NO: 30200 - DNA, 25 bp, Artificial Sequence
  Synthetic Construct
actggagcttcatcctttcatacaa

SEQ ID NO: 30201 - DNA, 28 bp, Artificial Sequence
  Synthetic Construct
cagaaagtaacaggtcagctcagaacta

SEQ ID NO: 30202 - DNA, 20 bp, Artificial Sequence
  Synthetic Construct
caggctcatggcagaactgt

SEQ ID NO: 30203 - DNA, 25 bp, Artificial Sequence
  Synthetic Construct
ctcaaataggcccttggcagaaaag

SEQ ID NO: 30204 - DNA, 28 bp, Artificial Sequence
  Synthetic Construct
ggtttgccatctagatcaatgcagactt

SEQ ID NO: 30205 - DNA, 27 bp, Artificial Sequence
  Synthetic Construct
caatccctgttaaattaccccatccat

SEQ ID NO: 30206 - DNA, 22 bp, Artificial Sequence
  Synthetic Construct
ctgaggaccctgtggttgagtt

SEQ ID NO: 30207 - DNA, 22 bp, Artificial Sequence
  Synthetic Construct
ggctgcttgctaattccagaga

SEQ ID NO: 30208 - DNA, 22 bp, Artificial Sequence
  Synthetic Construct
gcctctgtagagagcagcattc

SEQ ID NO: 30209 - DNA, 27 bp, Artificial Sequence
  Synthetic Construct
gtcctggattgtacttagaggaagaac

SEQ ID NO: 30210 - DNA, 20 bp, Artificial Sequence
  Synthetic Construct
acctcgagtcggaacctctt

SEQ ID NO: 30211 - DNA, 19 bp, Artificial Sequence
  Synthetic Construct
acctttcgggccctgcatt

SEQ ID NO: 30212 - DNA, 21 bp, Artificial Sequence
  Synthetic Construct
gcaacaggtctgtggcaaatg

SEQ ID NO: 30213 - DNA, 25 bp, Artificial Sequence
  Synthetic Construct
gtttaggacccctttctggtaacat

SEQ ID NO: 30214 - DNA, 21 bp, Artificial Sequence
  Synthetic Construct
accttctctggctgactgctt

SEQ ID NO: 30215 - DNA, 24 bp, Artificial Sequence
  Synthetic Construct
accatggtaacattggaaggtgaa

SEQ ID NO: 30216 - DNA, 25 bp, Artificial Sequence
  Synthetic Construct
ggcttgttcagtaaggttgtcagaa

SEQ ID NO: 30217 - DNA, 29 bp, Artificial Sequence
  Synthetic Construct
ccccaaatcaccacttaaatggaatcaga

SEQ ID NO: 30218 - DNA, 24 bp, Artificial Sequence
  Synthetic Construct
cgaggttccatcctagtcccaagt

SEQ ID NO: 30219 - DNA, 20 bp, Artificial Sequence
  Synthetic Construct
tgcccagtggatgacggaat

SEQ ID NO: 30220 - DNA, 24 bp, Artificial Sequence
  Synthetic Construct
cgaagcactgggaactgcagtaaa

SEQ ID NO: 30221 - DNA, 24 bp, Artificial Sequence
  Synthetic Construct
tgtgtatgaacacacagacaggtt

SEQ ID NO: 30222 - DNA, 24 bp, Artificial Sequence
  Synthetic Construct
acagcatggtgtaagcaagaaact

SEQ ID NO: 30223 - DNA, 26 bp, Artificial Sequence
  Synthetic Construct
gcggagaagagagttcagttttcatc

SEQ ID NO: 30224 - DNA, 21 bp, Artificial Sequence
  Synthetic Construct
ccatgcctgaaatgcggctaa

SEQ ID NO: 30225 - DNA, 24 bp, Artificial Sequence
  Synthetic Construct
ccctagggttgttcccttctcagt

SEQ ID NO: 30226 - DNA, 21 bp, Artificial Sequence
  Synthetic Construct
gtcaacgacaaccagcagaca

SEQ ID NO: 30227 - DNA, 23 bp, Artificial Sequence
  Synthetic Construct
gcacacctttggaatcagctact

SEQ ID NO: 30228 - DNA, 29 bp, Artificial Sequence
  Synthetic Construct
ggggtaaggaatgtgatgtagtttcattg

SEQ ID NO: 30229 - DNA, 23 bp, Artificial Sequence
  Synthetic Construct
ggggaaaccttgagaactgagaa

SEQ ID NO: 30230 - DNA, 24 bp, Artificial Sequence
  Synthetic Construct
aagctccctaaaagtcagcaaaga

SEQ ID NO: 30231 - DNA, 19 bp, Artificial Sequence
  Synthetic Construct
cctgggcttcggagagaga

SEQ ID NO: 30232 - DNA, 22 bp, Artificial Sequence
  Synthetic Construct
cagtcaccagagtgagcagtca

SEQ ID NO: 30233 - DNA, 21 bp, Artificial Sequence
  Synthetic Construct
gccatggggaataagcactca

SEQ ID NO: 30234 - DNA, 22 bp, Artificial Sequence
  Synthetic Construct
cacgccactcaagctgaaggaa

SEQ ID NO: 30235 - DNA, 20 bp, Artificial Sequence
  Synthetic Construct
cctgtggccaaggaggaaag

SEQ ID NO: 30236 - DNA, 19 bp, Artificial Sequence
  Synthetic Construct
tgccaggctgctcctgcat

SEQ ID NO: 30237 - DNA, 21 bp, Artificial Sequence
  Synthetic Construct
cccaggtcctcccctaagcat

SEQ ID NO: 30238 - DNA, 24 bp, Artificial Sequence
  Synthetic Construct
gacactgtccttgccaaccatttc

SEQ ID NO: 30239 - DNA, 22 bp, Artificial Sequence
  Synthetic Construct
gaccttgaagccaggtcctatg

SEQ ID NO: 30240 - DNA, 24 bp, Artificial Sequence
  Synthetic Construct
gactcccaggcaaagatctgagaa

SEQ ID NO: 30241 - DNA, 24 bp, Artificial Sequence
  Synthetic Construct
ccacaacagaagcatggtgcatac

SEQ ID NO: 30242 - DNA, 23 bp, Artificial Sequence
  Synthetic Construct
ctggagctgaagttgatggagat

SEQ ID NO: 30243 - DNA, 20 bp, Artificial Sequence
  Synthetic Construct
cgcctccgttggcaaatcaa

SEQ ID NO: 30244 - DNA, 27 bp, Artificial Sequence
  Synthetic Construct
gatggaaaccaacctttttcaccttct

SEQ ID NO: 30245 - DNA, 23 bp, Artificial Sequence
  Synthetic Construct
agagtagggctccccattctttt

SEQ ID NO: 30246 - DNA, 22 bp, Artificial Sequence
  Synthetic Construct
gtgaactttgggcatcctgtga

SEQ ID NO: 30247 - DNA, 20 bp, Artificial Sequence
  Synthetic Construct
gaacaggctgcttccgatca

SEQ ID NO: 30248 - DNA, 27 bp, Artificial Sequence
  Synthetic Construct
gggcttgagcatggattaaagggaaag

SEQ ID NO: 30249 - DNA, 24 bp, Artificial Sequence
  Synthetic Construct
gatgagtgcagactggaaaccatt

SEQ ID NO: 30250 - DNA, 22 bp, Artificial Sequence
  Synthetic Construct
gcctgaagaaactcggctctgt

SEQ ID NO: 30251 - DNA, 26 bp, Artificial Sequence
  Synthetic Construct
ctgtgtgaaggaaggaggatgaaagt

SEQ ID NO: 30252 - DNA, 24 bp, Artificial Sequence
  Synthetic Construct
ggcacatacagagttcagcctgtt

SEQ ID NO: 30253 - DNA, 19 bp, Artificial Sequence
  Synthetic Construct
acgccggtgctgtcgtact

SEQ ID NO: 30254 - DNA, 25 bp, Artificial Sequence
  Synthetic Construct
ctgactggttcctgtctccaagaag

SEQ ID NO: 30255 - DNA, 22 bp, Artificial Sequence
  Synthetic Construct
ggagcagggaaggatgcaacta

SEQ ID NO: 30256 - DNA, 26 bp, Artificial Sequence
  Synthetic Construct
caggatctagccctatgagcatgtta

SEQ ID NO: 30257 - DNA, 19 bp, Artificial Sequence
  Synthetic Construct
ggagccgcgcaggtttaca

SEQ ID NO: 30258 - DNA, 23 bp, Artificial Sequence
  Synthetic Construct
gtgagctctgtgaggatggagat

SEQ ID NO: 30259 - DNA, 27 bp, Artificial Sequence
  Synthetic Construct
gtgataacaggaaggggatgtttctct

SEQ ID NO: 30260 - DNA, 22 bp, Artificial Sequence
  Synthetic Construct
cactcagctggcactagtcttt

SEQ ID NO: 30261 - DNA, 23 bp, Artificial Sequence
  Synthetic Construct
tgggtggttttgctgtctaagtt

SEQ ID NO: 30262 - DNA, 21 bp, Artificial Sequence
  Synthetic Construct
ggggcaatgacactctctgtt

SEQ ID NO: 30263 - DNA, 25 bp, Artificial Sequence
  Synthetic Construct
ctctgtcttagttgctctgcttgat

SEQ ID NO: 30264 - DNA, 20 bp, Artificial Sequence
  Synthetic Construct
agctccagagcctagcactt

SEQ ID NO: 30265 - DNA, 24 bp, Artificial Sequence
  Synthetic Construct
gagaccatttcctgacagctggtt

SEQ ID NO: 30266 - DNA, 24 bp, Artificial Sequence
  Synthetic Construct
gggaagaatcctggacctcaccat

SEQ ID NO: 30267 - DNA, 27 bp, Artificial Sequence
  Synthetic Construct
cttgcctttactttgtggagtcattct

SEQ ID NO: 30268 - DNA, 26 bp, Artificial Sequence
  Synthetic Construct
ggaagtaacaccctacagaactggaa

SEQ ID NO: 30269 - DNA, 20 bp, Artificial Sequence
  Synthetic Construct
acctgagcccgggaggttga

SEQ ID NO: 30270 - DNA, 25 bp, Artificial Sequence
  Synthetic Construct
ccactcatgactgaaaacccatctt

SEQ ID NO: 30271 - DNA, 28 bp, Artificial Sequence
  Synthetic Construct
ggacaagcttcaagagttaggttaggta

SEQ ID NO: 30272 - DNA, 27 bp, Artificial Sequence
  Synthetic Construct
ggaaaatagccttccttcacagcctat

SEQ ID NO: 30273 - DNA, 22 bp, Artificial Sequence
  Synthetic Construct
gctggcaggggtcaggatttta

SEQ ID NO: 30274 - DNA, 27 bp, Artificial Sequence
  Synthetic Construct
cagttatgtcctaaagacccgtatcat

SEQ ID NO: 30275 - DNA, 22 bp, Artificial Sequence
  Synthetic Construct
gtgaaccagggtgagcaaattc

SEQ ID NO: 30276 - DNA, 26 bp, Artificial Sequence
  Synthetic Construct
cagcatcggggagtagtttaggtttc

SEQ ID NO: 30277 - DNA, 23 bp, Artificial Sequence
  Synthetic Construct
ggaggcagagaaatccagtttgt

SEQ ID NO: 30278 - DNA, 20 bp, Artificial Sequence
  Synthetic Construct
gcacccaagcctgcgagtaa

SEQ ID NO: 30279 - DNA, 26 bp, Artificial Sequence
  Synthetic Construct
ccgtctgtctaggaaaggaagctcta

SEQ ID NO: 30280 - DNA, 24 bp, Artificial Sequence
  Synthetic Construct
ctcacagagctataagcaggcaaa

SEQ ID NO: 30281 - DNA, 19 bp, Artificial Sequence
  Synthetic Construct
cctggcagggcgtcttttc

SEQ ID NO: 30282 - DNA, 20 bp, Artificial Sequence
  Synthetic Construct
gcgatcctccattgcaccat

SEQ ID NO: 30283 - DNA, 24 bp, Artificial Sequence
  Synthetic Construct
gctcagcaaatgcctactaacttg

SEQ ID NO: 30284 - DNA, 24 bp, Artificial Sequence
  Synthetic Construct
catgtctggaaactgcttcctgtt

SEQ ID NO: 30285 - DNA, 22 bp, Artificial Sequence
  Synthetic Construct
tgggtgagttggtgaggtctac

SEQ ID NO: 30286 - DNA, 21 bp, Artificial Sequence
  Synthetic Construct
gcctggctctgctccatttca

SEQ ID NO: 30287 - DNA, 24 bp, Artificial Sequence
  Synthetic Construct
aatgaggtataaggcaagccactt

SEQ ID NO: 30288 - DNA, 27 bp, Artificial Sequence
  Synthetic Construct
gcatcattacaggcagactttacaaac

SEQ ID NO: 30289 - DNA, 27 bp, Artificial Sequence
  Synthetic Construct
gaagatcatctgaaatttgccggattg

SEQ ID NO: 30290 - DNA, 22 bp, Artificial Sequence
  Synthetic Construct
gagaagccaaggtggctacaag

SEQ ID NO: 30291 - DNA, 24 bp, Artificial Sequence
  Synthetic Construct
ggcaggcttatgtacccactgaaa

SEQ ID NO: 30292 - DNA, 22 bp, Artificial Sequence
  Synthetic Construct
ggggtccttgctcatagagctt

SEQ ID NO: 30293 - DNA, 27 bp, Artificial Sequence
  Synthetic Construct
gcactctaggttgaataggtgcctaga

SEQ ID NO: 30294 - DNA, 26 bp, Artificial Sequence
  Synthetic Construct
ctgccaggaagtaggattcattcatt

SEQ ID NO: 30295 - DNA, 25 bp, Artificial Sequence
  Synthetic Construct
gtcctctgccacttgaagtctctat

SEQ ID NO: 30296 - DNA, 25 bp, Artificial Sequence
  Synthetic Construct
gagctggtgtagacagaggtgtttc

SEQ ID NO: 30297 - DNA, 23 bp, Artificial Sequence
  Synthetic Construct
cctgcaagagaggaatgcaaaac

SEQ ID NO: 30298 - DNA, 27 bp, Artificial Sequence
  Synthetic Construct
gcagttaactacttctcttagcagtga

SEQ ID NO: 30299 - DNA, 20 bp, Artificial Sequence
  Synthetic Construct
tgccggttcctctctcttct

SEQ ID NO: 30300 - DNA, 26 bp, Artificial Sequence
  Synthetic Construct
gaacatttgggttgcagaagtactga

SEQ ID NO: 30301 - DNA, 26 bp, Artificial Sequence
  Synthetic Construct
ggaaaaaccgaaggaccaaaagatga

SEQ ID NO: 30302 - DNA, 28 bp, Artificial Sequence
  Synthetic Construct
cgctgaagtggtatttacagtcatgaga

SEQ ID NO: 30303 - DNA, 24 bp, Artificial Sequence
  Synthetic Construct
cctcttaggtgttggttggcagaa

SEQ ID NO: 30304 - DNA, 23 bp, Artificial Sequence
  Synthetic Construct
cctccctggaaggctgtaaaatc

SEQ ID NO: 30305 - DNA, 22 bp, Artificial Sequence
  Synthetic Construct
aaaccgtgtgtgaaacctgaac

SEQ ID NO: 30306 - DNA, 18 bp, Artificial Sequence
  Synthetic Construct
tgggccttccccatgtct

SEQ ID NO: 30307 - DNA, 24 bp, Artificial Sequence
  Synthetic Construct
gcaacatttggaggtcagggaagt

SEQ ID NO: 30308 - DNA, 20 bp, Artificial Sequence
  Synthetic Construct
tgcgtgctgggagagctaag

SEQ ID NO: 30309 - DNA, 23 bp, Artificial Sequence
  Synthetic Construct
gtgtgtgacgctgagagatccaa

SEQ ID NO: 30310 - DNA, 20 bp, Artificial Sequence
  Synthetic Construct
tggaggctgaacgtgccttt

SEQ ID NO: 30311 - DNA, 26 bp, Artificial Sequence
  Synthetic Construct
caccctaggatgatgggatgactgaa

SEQ ID NO: 30312 - DNA, 22 bp, Artificial Sequence
  Synthetic Construct
tgaagaggaagtggcagagttg

SEQ ID NO: 30313 - DNA, 22 bp, Artificial Sequence
  Synthetic Construct
caggaggctcacagaagcttta

SEQ ID NO: 30314 - DNA, 20 bp, Artificial Sequence
  Synthetic Construct
gggagaggccaggtggaagt

SEQ ID NO: 30315 - DNA, 23 bp, Artificial Sequence
  Synthetic Construct
gggctggaatgttgtgtgggaaa

SEQ ID NO: 30316 - DNA, 26 bp, Artificial Sequence
  Synthetic Construct
caccaatatggaagagggttcagcat

SEQ ID NO: 30317 - DNA, 27 bp, Artificial Sequence
  Synthetic Construct
gttgcagagggatttaaagaagctgtt

SEQ ID NO: 30318 - DNA, 21 bp, Artificial Sequence
  Synthetic Construct
ttcagcgagacctgccctttc

SEQ ID NO: 30319 - DNA, 28 bp, Artificial Sequence
  Synthetic Construct
gggaaaaatcctgggtaactacttcttc

SEQ ID NO: 30320 - DNA, 26 bp, Artificial Sequence
  Synthetic Construct
gcacaaagacagacgtaagatgaaac

SEQ ID NO: 30321 - DNA, 26 bp, Artificial Sequence
  Synthetic Construct
ccaagcaaacagtgtacttcagacaa

SEQ ID NO: 30322 - DNA, 21 bp, Artificial Sequence
  Synthetic Construct
gcctccctgcttccttctgat

SEQ ID NO: 30323 - DNA, 22 bp, Artificial Sequence
  Synthetic Construct
gaccctccttcaactcgtggta

SEQ ID NO: 30324 - DNA, 25 bp, Artificial Sequence
  Synthetic Construct
gagtaaccacagctcatcctcatag

SEQ ID NO: 30325 - DNA, 26 bp, Artificial Sequence
  Synthetic Construct
gatcaagcagaaaggtcccttgttta

SEQ ID NO: 30326 - DNA, 29 bp, Artificial Sequence
  Synthetic Construct
cctggtatagcataaaggttgagagtgat

SEQ ID NO: 30327 - DNA, 24 bp, Artificial Sequence
  Synthetic Construct
tcttcaatcccttgtgtgccaata

SEQ ID NO: 30328 - DNA, 25 bp, Artificial Sequence
  Synthetic Construct
gcaattccatggggctgtagcatag

SEQ ID NO: 30329 - DNA, 24 bp, Artificial Sequence
  Synthetic Construct
gaaggaagggatggccattaggaa

SEQ ID NO: 30330 - DNA, 22 bp, Artificial Sequence
  Synthetic Construct
caccaccccaaccaatcccttt

SEQ ID NO: 30331 - DNA, 27 bp, Artificial Sequence
  Synthetic Construct
cacagccaaaccatatcaataggtgaa

SEQ ID NO: 30332 - DNA, 23 bp, Artificial Sequence
  Synthetic Construct
tgcttgaactccagatcagcaaa

SEQ ID NO: 30333 - DNA, 20 bp, Artificial Sequence
  Synthetic Construct
ctgcactgcgtttccagcta

SEQ ID NO: 30334 - DNA, 25 bp, Artificial Sequence
  Synthetic Construct
gtgcaatacactgggtttgctgtag

SEQ ID NO: 30335 - DNA, 24 bp, Artificial Sequence
  Synthetic Construct
actgtgtgtagagagaccttgtga

SEQ ID NO: 30336 - DNA, 27 bp, Artificial Sequence
  Synthetic Construct
ctagcacattgactgaaggagatagaa

SEQ ID NO: 30337 - DNA, 24 bp, Artificial Sequence
  Synthetic Construct
gacagaatggagcaggtgctaaga

SEQ ID NO: 30338 - DNA, 30 bp, Artificial Sequence
  Synthetic Construct
ctcagagtcaatataaccatcgctaaccaa

SEQ ID NO: 30339 - DNA, 22 bp, Artificial Sequence
  Synthetic Construct
ccgccatgcagtttctctcttg

SEQ ID NO: 30340 - DNA, 26 bp, Artificial Sequence
  Synthetic Construct
gctcagtggaattgatttgtcggtaa

SEQ ID NO: 30341 - DNA, 22 bp, Artificial Sequence
  Synthetic Construct
agctgaaggggtttccacaatg

SEQ ID NO: 30342 - DNA, 19 bp, Artificial Sequence
  Synthetic Construct
actccggcagagactcgaa

SEQ ID NO: 30343 - DNA, 25 bp, Artificial Sequence
  Synthetic Construct
gaccaacacataggttagggtcttg

SEQ ID NO: 30344 - DNA, 26 bp, Artificial Sequence
  Synthetic Construct
caggaacggcaggaaataagagattt

SEQ ID NO: 30345 - DNA, 27 bp, Artificial Sequence
  Synthetic Construct
gaatagggaattgaggaggaatgttga

SEQ ID NO: 30346 - DNA, 30 bp, Artificial Sequence
  Synthetic Construct
gagaaacctgcctaatacaaaatccctttc

SEQ ID NO: 30347 - DNA, 24 bp, Artificial Sequence
  Synthetic Construct
cgtctgcttttggaggatctgaac

SEQ ID NO: 30348 - DNA, 22 bp, Artificial Sequence
  Synthetic Construct
ggactccgaccagttcctctct

SEQ ID NO: 30349 - DNA, 23 bp, Artificial Sequence
  Synthetic Construct
tgtcaggtaggattgggatggtt

SEQ ID NO: 30350 - DNA, 22 bp, Artificial Sequence
  Synthetic Construct
gggaggcaggacaccttttctt

SEQ ID NO: 30351 - DNA, 19 bp, Artificial Sequence
  Synthetic Construct
agggaggcatcccctgaag

SEQ ID NO: 30352 - DNA, 23 bp, Artificial Sequence
  Synthetic Construct
cagccattagagaaccacagact

SEQ ID NO: 30353 - DNA, 23 bp, Artificial Sequence
  Synthetic Construct
tgagaaagcgccctgttctaatg

SEQ ID NO: 30354 - DNA, 25 bp, Artificial Sequence
  Synthetic Construct
tcagggagtggtaaataaggctaga

SEQ ID NO: 30355 - DNA, 22 bp, Artificial Sequence
  Synthetic Construct
tggggtgcagggactccttaaa

SEQ ID NO: 30356 - DNA, 26 bp, Artificial Sequence
  Synthetic Construct
cctctgatctcactccctgattcact

SEQ ID NO: 30357 - DNA, 19 bp, Artificial Sequence
  Synthetic Construct
tcccggccttttgctggat

SEQ ID NO: 30358 - DNA, 23 bp, Artificial Sequence
  Synthetic Construct
gaattactctggctcacgctctt

SEQ ID NO: 30359 - DNA, 24 bp, Artificial Sequence
  Synthetic Construct
gcaggtacaggtttaggcttctct

SEQ ID NO: 30360 - DNA, 25 bp, Artificial Sequence
  Synthetic Construct
gtctcttatccatccacagcaagaa

SEQ ID NO: 30361 - DNA, 24 bp, Artificial Sequence
  Synthetic Construct
tccattctagggaccaatcgtact

SEQ ID NO: 30362 - DNA, 20 bp, Artificial Sequence
  Synthetic Construct
cagccaagagctcgcattca

SEQ ID NO: 30363 - DNA, 22 bp, Artificial Sequence
  Synthetic Construct
agcaagcagcaagccattttac

SEQ ID NO: 30364 - DNA, 26 bp, Artificial Sequence
  Synthetic Construct
gggtcagttattgccaagagtgattt

SEQ ID NO: 30365 - DNA, 28 bp, Artificial Sequence
  Synthetic Construct
ggactttcaaggagatgaatcccaaaga

SEQ ID NO: 30366 - DNA, 25 bp, Artificial Sequence
  Synthetic Construct
cctgtttcttttcaagggaggctat

SEQ ID NO: 30367 - DNA, 27 bp, Artificial Sequence
  Synthetic Construct
ctcaatagtatttgacacgctctctct

SEQ ID NO: 30368 - DNA, 22 bp, Artificial Sequence
  Synthetic Construct
tctgggtggggctgtgagtaaa

SEQ ID NO: 30369 - DNA, 25 bp, Artificial Sequence
  Synthetic Construct
gctcatctggggaaagatgtcacta

SEQ ID NO: 30370 - DNA, 28 bp, Artificial Sequence
  Synthetic Construct
gtctcatggaaagcaagtgacattgttc

SEQ ID NO: 30371 - DNA, 26 bp, Artificial Sequence
  Synthetic Construct
ggtgatttaagagcaagggttagctt

SEQ ID NO: 30372 - DNA, 22 bp, Artificial Sequence
  Synthetic Construct
ttaagccccaggctgctgaatc

SEQ ID NO: 30373 - DNA, 22 bp, Artificial Sequence
  Synthetic Construct
tgtgtgccatctgctttcacaa

SEQ ID NO: 30374 - DNA, 24 bp, Artificial Sequence
  Synthetic Construct
ctctttgcttccaaggctgaaatc

SEQ ID NO: 30375 - DNA, 22 bp, Artificial Sequence
  Synthetic Construct
ctggtcacagggctttctcctt

SEQ ID NO: 30376 - DNA, 23 bp, Artificial Sequence
  Synthetic Construct
cctgcccgccttttagataatgt

SEQ ID NO: 30377 - DNA, 21 bp, Artificial Sequence
  Synthetic Construct
ggccatgccctctccatgtat

SEQ ID NO: 30378 - DNA, 20 bp, Artificial Sequence
  Synthetic Construct
aagggctgaccctcttcagt

SEQ ID NO: 30379 - DNA, 20 bp, Artificial Sequence
  Synthetic Construct
agagcctcaggcggaccttt

SEQ ID NO: 30380 - DNA, 27 bp, Artificial Sequence
  Synthetic Construct
cgattcttgttcgaatggaaggtaatg

SEQ ID NO: 30381 - DNA, 30 bp, Artificial Sequence
  Synthetic Construct
caggtgttagtaaacatagtcctctccaaa

SEQ ID NO: 30382 - DNA, 22 bp, Artificial Sequence
  Synthetic Construct
ctgaggtgggtttgctctctgt

SEQ ID NO: 30383 - DNA, 27 bp, Artificial Sequence
  Synthetic Construct
ggagaaactgatcaggtccctatttct

SEQ ID NO: 30384 - DNA, 28 bp, Artificial Sequence
  Synthetic Construct
gcgaatcaccaaaaggaaaacacacttg

SEQ ID NO: 30385 - DNA, 22 bp, Artificial Sequence
  Synthetic Construct
caggtgaagtttcccggcatga

SEQ ID NO: 30386 - DNA, 21 bp, Artificial Sequence
  Synthetic Construct
ccagacctgggaccaagaaca

SEQ ID NO: 30387 - DNA, 22 bp, Artificial Sequence
  Synthetic Construct
caggggctaattggatgcagaa

SEQ ID NO: 30388 - DNA, 27 bp, Artificial Sequence
  Synthetic Construct
ggctgagagtaaatggtgactttcaca

SEQ ID NO: 30389 - DNA, 20 bp, Artificial Sequence
  Synthetic Construct
agtcctggatcccgttcagt

SEQ ID NO: 30390 - DNA, 24 bp, Artificial Sequence
  Synthetic Construct
ccaaatctgatggggtaggcaaca

SEQ ID NO: 30391 - DNA, 22 bp, Artificial Sequence
  Synthetic Construct
gcacagcacagatgctccacta

SEQ ID NO: 30392 - DNA, 20 bp, Artificial Sequence
  Synthetic Construct
tgggcacgtttgtccaagat

SEQ ID NO: 30393 - DNA, 18 bp, Artificial Sequence
  Synthetic Construct
aggagggacccaggcaaa

SEQ ID NO: 30394 - DNA, 23 bp, Artificial Sequence
  Synthetic Construct
ggaccaggattcgaggagttaag

SEQ ID NO: 30395 - DNA, 28 bp, Artificial Sequence
  Synthetic Construct
ccaggtttgtctttaaagggatggaatg

SEQ ID NO: 30396 - DNA, 27 bp, Artificial Sequence
  Synthetic Construct
gtaagtgactttcagggagattgaatg

SEQ ID NO: 30397 - DNA, 26 bp, Artificial Sequence
  Synthetic Construct
gcaaagacaatgaaagcaccatcatc

SEQ ID NO: 30398 - DNA, 22 bp, Artificial Sequence
  Synthetic Construct
gcaactgcctagagagctgatt

SEQ ID NO: 30399 - DNA, 20 bp, Artificial Sequence
  Synthetic Construct
tgcccgggacagacccagat

SEQ ID NO: 30400 - DNA, 19 bp, Artificial Sequence
  Synthetic Construct
tgcagcagctggtggttgt

SEQ ID NO: 30401 - DNA, 21 bp, Artificial Sequence
  Synthetic Construct
acggtgacacttgtgttgtga

SEQ ID NO: 30402 - DNA, 27 bp, Artificial Sequence
  Synthetic Construct
tgaaggaataaccataccttcctcatc

SEQ ID NO: 30403 - DNA, 24 bp, Artificial Sequence
  Synthetic Construct
gctgtcagaatggggtatgtgtgt

SEQ ID NO: 30404 - DNA, 21 bp, Artificial Sequence
  Synthetic Construct
ggacacccctgccgtagacat

SEQ ID NO: 30405 - DNA, 26 bp, Artificial Sequence
  Synthetic Construct
gacatgggcctttcattgaactctct

SEQ ID NO: 30406 - DNA, 26 bp, Artificial Sequence
  Synthetic Construct
ctcttactggaaatgatggcttgtct

SEQ ID NO: 30407 - DNA, 20 bp, Artificial Sequence
  Synthetic Construct
ggtttcacgggatgcctttg

SEQ ID NO: 30408 - DNA, 25 bp, Artificial Sequence
  Synthetic Construct
aggggctttgctgaaatgatatgaa

SEQ ID NO: 30409 - DNA, 22 bp, Artificial Sequence
  Synthetic Construct
gttgatgccactgtcagcagtt

SEQ ID NO: 30410 - DNA, 21 bp, Artificial Sequence
  Synthetic Construct
tccttgcgagactttgtggtt

SEQ ID NO: 30411 - DNA, 20 bp, Artificial Sequence
  Synthetic Construct
gggactgcagcaatgtggta

SEQ ID NO: 30412 - DNA, 28 bp, Artificial Sequence
  Synthetic Construct
ctccattgatttagagctgatccactga

SEQ ID NO: 30413 - DNA, 22 bp, Artificial Sequence
  Synthetic Construct
ccaatgtacaggcatggcttct

SEQ ID NO: 30414 - DNA, 22 bp, Artificial Sequence
  Synthetic Construct
ccaagcagggtgctatttctca

SEQ ID NO: 30415 - DNA, 22 bp, Artificial Sequence
  Synthetic Construct
ggggataggactgggtttcaga

SEQ ID NO: 30416 - DNA, 21 bp, Artificial Sequence
  Synthetic Construct
gccttaaggagcagcgttttg

SEQ ID NO: 30417 - DNA, 24 bp, Artificial Sequence
  Synthetic Construct
gcccttcattgctatcctgtggtt

SEQ ID NO: 30418 - DNA, 24 bp, Artificial Sequence
  Synthetic Construct
gtatgttgccatctgtagccaatg

SEQ ID NO: 30419 - DNA, 20 bp, Artificial Sequence
  Synthetic Construct
caggcacaccaccaatcgtt

SEQ ID NO: 30420 - DNA, 25 bp, Artificial Sequence
  Synthetic Construct
gctgaaattagtcaccgaccaccaa

SEQ ID NO: 30421 - DNA, 26 bp, Artificial Sequence
  Synthetic Construct
gctcttccaagaaaggcaagtgaaag

SEQ ID NO: 30422 - DNA, 20 bp, Artificial Sequence
  Synthetic Construct
cagctttcacggctcagtgt

SEQ ID NO: 30423 - DNA, 25 bp, Artificial Sequence
  Synthetic Construct
ccattaccacaatctgggctgtttc

SEQ ID NO: 30424 - DNA, 22 bp, Artificial Sequence
  Synthetic Construct
tgcctggtacaggtgaggctta

SEQ ID NO: 30425 - DNA, 25 bp, Artificial Sequence
  Synthetic Construct
gagacccaggagtcttccttgttac

SEQ ID NO: 30426 - DNA, 25 bp, Artificial Sequence
  Synthetic Construct
gtcacaaagaagggagaggttcaca

SEQ ID NO: 30427 - DNA, 27 bp, Artificial Sequence
  Synthetic Construct
cctccctttaaggtcctttccagaagt

SEQ ID NO: 30428 - DNA, 20 bp, Artificial Sequence
  Synthetic Construct
acgtgcagcagtggatgcta

SEQ ID NO: 30429 - DNA, 25 bp, Artificial Sequence
  Synthetic Construct
gccaggtgatcttagacctgcacta

SEQ ID NO: 30430 - DNA, 30 bp, Artificial Sequence
  Synthetic Construct
gcattacttaccttgactcttagcttgttg

SEQ ID NO: 30431 - DNA, 29 bp, Artificial Sequence
  Synthetic Construct
gtggagggcttataatgaggcttgtatag

SEQ ID NO: 30432 - DNA, 21 bp, Artificial Sequence
  Synthetic Construct
cctagcagctgttggcagaag

SEQ ID NO: 30433 - DNA, 21 bp, Artificial Sequence
  Synthetic Construct
gcctgatgtgatgctggaaac

SEQ ID NO: 30434 - DNA, 20 bp, Artificial Sequence
  Synthetic Construct
gcatgacagcacaggctcat

SEQ ID NO: 30435 - DNA, 28 bp, Artificial Sequence
  Synthetic Construct
ctgaagaggacttcttgactttggtaag

SEQ ID NO: 30436 - DNA, 24 bp, Artificial Sequence
  Synthetic Construct
gacattggtgcatgtgatgtctgt

SEQ ID NO: 30437 - DNA, 22 bp, Artificial Sequence
  Synthetic Construct
taacgcgcctgggctctccttt

SEQ ID NO: 30438 - DNA, 24 bp, Artificial Sequence
  Synthetic Construct
gccgatgaactgggtttggaaatg

SEQ ID NO: 30439 - DNA, 25 bp, Artificial Sequence
  Synthetic Construct
tgatcttctttcgtggcaacagatt

SEQ ID NO: 30440 - DNA, 23 bp, Artificial Sequence
  Synthetic Construct
ggaaggataactccacccagtca

SEQ ID NO: 30441 - DNA, 21 bp, Artificial Sequence
  Synthetic Construct
gctgcttttgcgctacagtga

SEQ ID NO: 30442 - DNA, 22 bp, Artificial Sequence
  Synthetic Construct
gccctgcacctccatatgttct

SEQ ID NO: 30443 - DNA, 23 bp, Artificial Sequence
  Synthetic Construct
tggtatggaggagtgttgtggat

SEQ ID NO: 30444 - DNA, 25 bp, Artificial Sequence
  Synthetic Construct
actacgtggaacagagctgatagat

SEQ ID NO: 30445 - DNA, 24 bp, Artificial Sequence
  Synthetic Construct
gctggaaggggagtctggtattct

SEQ ID NO: 30446 - DNA, 22 bp, Artificial Sequence
  Synthetic Construct
cccatccttgtcagctccagat

SEQ ID NO: 30447 - DNA, 21 bp, Artificial Sequence
  Synthetic Construct
gatggtgccaacatgctcaac

SEQ ID NO: 30448 - DNA, 23 bp, Artificial Sequence
  Synthetic Construct
ggccccaaggaaatgatggattc

SEQ ID NO: 30449 - DNA, 24 bp, Artificial Sequence
  Synthetic Construct
acatatgcctcagtagcaagttgt

SEQ ID NO: 30450 - DNA, 23 bp, Artificial Sequence
  Synthetic Construct
gattcccacgtccgtgatttact

SEQ ID NO: 30451 - DNA, 28 bp, Artificial Sequence
  Synthetic Construct
ggtgtgaaagcaatacacattcggtaga

SEQ ID NO: 30452 - DNA, 22 bp, Artificial Sequence
  Synthetic Construct
tgttatctgtgcgtgcttgtct

SEQ ID NO: 30453 - DNA, 25 bp, Artificial Sequence
  Synthetic Construct
gcacactgacaaagtaggggagttg

SEQ ID NO: 30454 - DNA, 22 bp, Artificial Sequence
  Synthetic Construct
tggagtgagcaaagtgttgcat

SEQ ID NO: 30455 - DNA, 24 bp, Artificial Sequence
  Synthetic Construct
cacagggagagaaaagcagggaaa

SEQ ID NO: 30456 - DNA, 23 bp, Artificial Sequence
  Synthetic Construct
agttctcactttgagctgtggtt

SEQ ID NO: 30457 - DNA, 25 bp, Artificial Sequence
  Synthetic Construct
gaacagttgctgatccttctgattc

SEQ ID NO: 30458 - DNA, 26 bp, Artificial Sequence
  Synthetic Construct
gttggagtcacctattcaggtaaaga

SEQ ID NO: 30459 - DNA, 26 bp, Artificial Sequence
  Synthetic Construct
gtttatgtcctggtgtccttacttgt

SEQ ID NO: 30460 - DNA, 27 bp, Artificial Sequence
  Synthetic Construct
gacaaacagtcctacttggggagtttt

SEQ ID NO: 30461 - DNA, 24 bp, Artificial Sequence
  Synthetic Construct
gcccagaaagagacctaagtgcat

SEQ ID NO: 30462 - DNA, 27 bp, Artificial Sequence
  Synthetic Construct
cctaatttagctccttgagactcagat

SEQ ID NO: 30463 - DNA, 22 bp, Artificial Sequence
  Synthetic Construct
agggactggtaacctgagtcaa

SEQ ID NO: 30464 - DNA, 25 bp, Artificial Sequence
  Synthetic Construct
ggagtaggggtcagtatagggattg

SEQ ID NO: 30465 - DNA, 25 bp, Artificial Sequence
  Synthetic Construct
gcacagcaagcaaggagtaaatgat

SEQ ID NO: 30466 - DNA, 27 bp, Artificial Sequence
  Synthetic Construct
gcacagacatccatctagaaaaacaag

SEQ ID NO: 30467 - DNA, 23 bp, Artificial Sequence
  Synthetic Construct
gattctgggaggacagatgcttt

SEQ ID NO: 30468 - DNA, 22 bp, Artificial Sequence
  Synthetic Construct
cccaagtgaggcctctgaaatc

SEQ ID NO: 30469 - DNA, 25 bp, Artificial Sequence
  Synthetic Construct
gcagcttaaccagcacaattggatt

SEQ ID NO: 30470 - DNA, 23 bp, Artificial Sequence
  Synthetic Construct
tccagagaggtcacaccattctt

SEQ ID NO: 30471 - DNA, 22 bp, Artificial Sequence
  Synthetic Construct
agcagctgggaagaagtacaga

SEQ ID NO: 30472 - DNA, 30 bp, Artificial Sequence
  Synthetic Construct
cctcttgctaattgctatctccaagtgttt

SEQ ID NO: 30473 - DNA, 22 bp, Artificial Sequence
  Synthetic Construct
ggaggtgtttcctgggagaaag

SEQ ID NO: 30474 - DNA, 23 bp, Artificial Sequence
  Synthetic Construct
ttcagggacagagtctgagatgt

SEQ ID NO: 30475 - DNA, 24 bp, Artificial Sequence
  Synthetic Construct
ggggtaataggctttgctgtgaag

SEQ ID NO: 30476 - DNA, 22 bp, Artificial Sequence
  Synthetic Construct
cctccttgattcaccgctcagt

SEQ ID NO: 30477 - DNA, 23 bp, Artificial Sequence
  Synthetic Construct
ctcactgttgctgtcggtattca

SEQ ID NO: 30478 - DNA, 27 bp, Artificial Sequence
  Synthetic Construct
gcagaagaatcaaacttacccttgtgt

SEQ ID NO: 30479 - DNA, 27 bp, Artificial Sequence
  Synthetic Construct
cagaaaagaaacgctttcctgcaaatg

SEQ ID NO: 30480 - DNA, 22 bp, Artificial Sequence
  Synthetic Construct
ccttatccgcatccagttcagt

SEQ ID NO: 30481 - DNA, 21 bp, Artificial Sequence
  Synthetic Construct
cacctttttcccctgctccaa

SEQ ID NO: 30482 - DNA, 21 bp, Artificial Sequence
  Synthetic Construct
cgctgaccctcccatagtgtt

SEQ ID NO: 30483 - DNA, 24 bp, Artificial Sequence
  Synthetic Construct
gcaagggttgaaaactacacatca

SEQ ID NO: 30484 - DNA, 25 bp, Artificial Sequence
  Synthetic Construct
tcaagtcctcatcttatccccaagt

SEQ ID NO: 30485 - DNA, 22 bp, Artificial Sequence
  Synthetic Construct
tgccctgtgcagtaaactttca

SEQ ID NO: 30486 - DNA, 20 bp, Artificial Sequence
  Synthetic Construct
gccgtcttgggtggttcaca

SEQ ID NO: 30487 - DNA, 21 bp, Artificial Sequence
  Synthetic Construct
gccacacaccacctcttgagt

SEQ ID NO: 30488 - DNA, 24 bp, Artificial Sequence
  Synthetic Construct
tggcagtttttcactctccttact

SEQ ID NO: 30489 - DNA, 19 bp, Artificial Sequence
  Synthetic Construct
tgccaggctgtccacatca

SEQ ID NO: 30490 - DNA, 24 bp, Artificial Sequence
  Synthetic Construct
tcacagtggctacatcaaagtcat

SEQ ID NO: 30491 - DNA, 26 bp, Artificial Sequence
  Synthetic Construct
ggggcaggcatataatacacaatcaa

SEQ ID NO: 30492 - DNA, 28 bp, Artificial Sequence
  Synthetic Construct
ccagacattgtgttcagttctgtgtcta

SEQ ID NO: 30493 - DNA, 22 bp, Artificial Sequence
  Synthetic Construct
tggccccattgggaagtaggat

SEQ ID NO: 30494 - DNA, 21 bp, Artificial Sequence
  Synthetic Construct
tccacagcaggggctgttcta

SEQ ID NO: 30495 - DNA, 24 bp, Artificial Sequence
  Synthetic Construct
cgcccagacacatactggaggatt

SEQ ID NO: 30496 - DNA, 25 bp, Artificial Sequence
  Synthetic Construct
gctgacttccagcttgtaggatttg

SEQ ID NO: 30497 - DNA, 25 bp, Artificial Sequence
  Synthetic Construct
catttgagacttccagaggagttga

SEQ ID NO: 30498 - DNA, 22 bp, Artificial Sequence
  Synthetic Construct
gaagaagcaacgcactggatca

SEQ ID NO: 30499 - DNA, 23 bp, Artificial Sequence
  Synthetic Construct
cacccacagcctatgtcacattt

SEQ ID NO: 30500 - DNA, 27 bp, Artificial Sequence
  Synthetic Construct
gaaggcagatataggaattcagacgtt

SEQ ID NO: 30501 - DNA, 23 bp, Artificial Sequence
  Synthetic Construct
ccaggaggacttgcatttcagta

SEQ ID NO: 30502 - DNA, 26 bp, Artificial Sequence
  Synthetic Construct
cctgccctgattaccctaagccaata

SEQ ID NO: 30503 - DNA, 24 bp, Artificial Sequence
  Synthetic Construct
aggggattcatgcagtttggataa

SEQ ID NO: 30504 - DNA, 23 bp, Artificial Sequence
  Synthetic Construct
tcaccaccaatcacaaggaagaa

SEQ ID NO: 30505 - DNA, 30 bp, Artificial Sequence
  Synthetic Construct
gttccatataggccttgttcttctacaaag

SEQ ID NO: 30506 - DNA, 22 bp, Artificial Sequence
  Synthetic Construct
gcgtattcctagggcctgaagt

SEQ ID NO: 30507 - DNA, 24 bp, Artificial Sequence
  Synthetic Construct
gaccaaatggaatgctcagctaca

SEQ ID NO: 30508 - DNA, 30 bp, Artificial Sequence
  Synthetic Construct
ggaatgtgtaagaggttaagatcccatttc

SEQ ID NO: 30509 - DNA, 24 bp, Artificial Sequence
  Synthetic Construct
aggatgttatgtggcaaggatgat

SEQ ID NO: 30510 - DNA, 24 bp, Artificial Sequence
  Synthetic Construct
accacttgaaagcagggatagttg

SEQ ID NO: 30511 - DNA, 22 bp, Artificial Sequence
  Synthetic Construct
ggcagaactcaaggggcaaaac

SEQ ID NO: 30512 - DNA, 25 bp, Artificial Sequence
  Synthetic Construct
cctggcaaccttcatttaacccaaa

SEQ ID NO: 30513 - DNA, 21 bp, Artificial Sequence
  Synthetic Construct
gctttgtgaaggggtgtccta

SEQ ID NO: 30514 - DNA, 28 bp, Artificial Sequence
  Synthetic Construct
ggaaaaagaagtggactgacatcggaat

SEQ ID NO: 30515 - DNA, 22 bp, Artificial Sequence
  Synthetic Construct
aatcccaaccctctgtgctttt

SEQ ID NO: 30516 - DNA, 26 bp, Artificial Sequence
  Synthetic Construct
ctgcatctgctgtatctctagtgtct

SEQ ID NO: 30517 - DNA, 25 bp, Artificial Sequence
  Synthetic Construct
gaaaaggaagggaatgtacccagta

SEQ ID NO: 30518 - DNA, 23 bp, Artificial Sequence
  Synthetic Construct
ccccaggcctttggctgttatac

SEQ ID NO: 30519 - DNA, 29 bp, Artificial Sequence
  Synthetic Construct
cctaagaatgcacaaggctattgaagatg

SEQ ID NO: 30520 - DNA, 22 bp, Artificial Sequence
  Synthetic Construct
gccctgcatcagtgctactaag

SEQ ID NO: 30521 - DNA, 25 bp, Artificial Sequence
  Synthetic Construct
gcccggccaagatcatgacttttat

SEQ ID NO: 30522 - DNA, 25 bp, Artificial Sequence
  Synthetic Construct
ggaaggccgctatcatccttattca

SEQ ID NO: 30523 - DNA, 22 bp, Artificial Sequence
  Synthetic Construct
gtggacagtgcctttctgagta

SEQ ID NO: 30524 - DNA, 27 bp, Artificial Sequence
  Synthetic Construct
ggcattgccaacctttacagacctatc

SEQ ID NO: 30525 - DNA, 26 bp, Artificial Sequence
  Synthetic Construct
ccctggagtcaacatcagagttttgt

SEQ ID NO: 30526 - DNA, 22 bp, Artificial Sequence
  Synthetic Construct
gtggagtcactaggctgaccaa

SEQ ID NO: 30527 - DNA, 25 bp, Artificial Sequence
  Synthetic Construct
ctcctttattccccagattggttga

SEQ ID NO: 30528 - DNA, 24 bp, Artificial Sequence
  Synthetic Construct
gcagagtcatcaaaagccactttc

SEQ ID NO: 30529 - DNA, 26 bp, Artificial Sequence
  Synthetic Construct
ggccctccaaacatcattagtccaaa

SEQ ID NO: 30530 - DNA, 23 bp, Artificial Sequence
  Synthetic Construct
ggcctcccttgaagaatcgttgt

SEQ ID NO: 30531 - DNA, 23 bp, Artificial Sequence
  Synthetic Construct
ggctcaccagaatcctagcaaaa

SEQ ID NO: 30532 - DNA, 25 bp, Artificial Sequence
  Synthetic Construct
ttgctataaccactcagtcctttgt

SEQ ID NO: 30533 - DNA, 24 bp, Artificial Sequence
  Synthetic Construct
gggaatgtcttccaggggatgttt

SEQ ID NO: 30534 - DNA, 24 bp, Artificial Sequence
  Synthetic Construct
gcattaccatgccctgtgattaag

SEQ ID NO: 30535 - DNA, 27 bp, Artificial Sequence
  Synthetic Construct
ggggactactaccagtgttaagtgaga

SEQ ID NO: 30536 - DNA, 23 bp, Artificial Sequence
  Synthetic Construct
tccaggctgctatcatctcttct

SEQ ID NO: 30537 - DNA, 28 bp, Artificial Sequence
  Synthetic Construct
cccttcagtgtcaaccttatggatcttc

SEQ ID NO: 30538 - DNA, 23 bp, Artificial Sequence
  Synthetic Construct
gctcatcttccatcggagcaact

SEQ ID NO: 30539 - DNA, 22 bp, Artificial Sequence
  Synthetic Construct
accaaaacgcctccagaaaagt

SEQ ID NO: 30540 - DNA, 21 bp, Artificial Sequence
  Synthetic Construct
tcacaggcagagtagggcata

SEQ ID NO: 30541 - DNA, 22 bp, Artificial Sequence
  Synthetic Construct
agagaggacatcaggggaacaa

SEQ ID NO: 30542 - DNA, 26 bp, Artificial Sequence
  Synthetic Construct
ggccatggcaaataggaaaaggtttg

SEQ ID NO: 30543 - DNA, 22 bp, Artificial Sequence
  Synthetic Construct
gcccagaaaccaggagatgatg

SEQ ID NO: 30544 - DNA, 21 bp, Artificial Sequence
  Synthetic Construct
catgtacccacgcctgaatct

SEQ ID NO: 30545 - DNA, 24 bp, Artificial Sequence
  Synthetic Construct
gcaaagattcaggcatcggaataa

SEQ ID NO: 30546 - DNA, 22 bp, Artificial Sequence
  Synthetic Construct
tggaattggcagggtcttctct

SEQ ID NO: 30547 - DNA, 23 bp, Artificial Sequence
  Synthetic Construct
cagacgcacctagagttgtccta

SEQ ID NO: 30548 - DNA, 27 bp, Artificial Sequence
  Synthetic Construct
ccagagtcggtattttcaatcaccaaa

SEQ ID NO: 30549 - DNA, 26 bp, Artificial Sequence
  Synthetic Construct
gtgtgtcatattctcccctaggactt

SEQ ID NO: 30550 - DNA, 22 bp, Artificial Sequence
  Synthetic Construct
cccagacatgcccttgaccttt

SEQ ID NO: 30551 - DNA, 27 bp, Artificial Sequence
  Synthetic Construct
ggctagaactgaaaaacagaggctgta

SEQ ID NO: 30552 - DNA, 22 bp, Artificial Sequence
  Synthetic Construct
tgaccagggttcacacctcaga

SEQ ID NO: 30553 - DNA, 27 bp, Artificial Sequence
  Synthetic Construct
gggctatcaccagtttgactattctgt

SEQ ID NO: 30554 - DNA, 30 bp, Artificial Sequence
  Synthetic Construct
ccatgttagagggtttaagtcatggagttc

SEQ ID NO: 30555 - DNA, 26 bp, Artificial Sequence
  Synthetic Construct
gtaggtaaattggtaacaggcagttg

SEQ ID NO: 30556 - DNA, 22 bp, Artificial Sequence
  Synthetic Construct
tccagtggcgaaatgtttctgt

SEQ ID NO: 30557 - DNA, 29 bp, Artificial Sequence
  Synthetic Construct
ccagactaagatgtcaaggagacttggtt

SEQ ID NO: 30558 - DNA, 22 bp, Artificial Sequence
  Synthetic Construct
tgattgccacttccatgccatt

SEQ ID NO: 30559 - DNA, 23 bp, Artificial Sequence
  Synthetic Construct
ccacgttgtaggctgtgttattc

SEQ ID NO: 30560 - DNA, 22 bp, Artificial Sequence
  Synthetic Construct
gcccaaaacctctctctcagaa

SEQ ID NO: 30561 - DNA, 25 bp, Artificial Sequence
  Synthetic Construct
tcaggattttgtgagtgttcggtta

SEQ ID NO: 30562 - DNA, 21 bp, Artificial Sequence
  Synthetic Construct
aggcatggagcctcttcttga

SEQ ID NO: 30563 - DNA, 27 bp, Artificial Sequence
  Synthetic Construct
ccttgtgtgagatccttaggccaaaac

SEQ ID NO: 30564 - DNA, 28 bp, Artificial Sequence
  Synthetic Construct
gccctagatagtcaccccttatctgtct

SEQ ID NO: 30565 - DNA, 25 bp, Artificial Sequence
  Synthetic Construct
ctgtcctagctcctggtaaaagttc

SEQ ID NO: 30566 - DNA, 24 bp, Artificial Sequence
  Synthetic Construct
tttccctgaaatgatggcactaca

SEQ ID NO: 30567 - DNA, 21 bp, Artificial Sequence
  Synthetic Construct
aaggctggcttcgggtagaga

SEQ ID NO: 30568 - DNA, 20 bp, Artificial Sequence
  Synthetic Construct
ggtactgctaccgtgctgtt

SEQ ID NO: 30569 - DNA, 24 bp, Artificial Sequence
  Synthetic Construct
agcacacttggcatgaaaagaaag

SEQ ID NO: 30570 - DNA, 21 bp, Artificial Sequence
  Synthetic Construct
ggagcattgcttgaggagaca

SEQ ID NO: 30571 - DNA, 22 bp, Artificial Sequence
  Synthetic Construct
ggaatgaagagggcttctcaca

SEQ ID NO: 30572 - DNA, 27 bp, Artificial Sequence
  Synthetic Construct
gggcagcatgaatgacattgtatctct

SEQ ID NO: 30573 - DNA, 20 bp, Artificial Sequence
  Synthetic Construct
ggatgccatggctgccaaac

SEQ ID NO: 30574 - DNA, 24 bp, Artificial Sequence
  Synthetic Construct
ggaggagaagcagagagcatgaga

SEQ ID NO: 30575 - DNA, 23 bp, Artificial Sequence
  Synthetic Construct
cctccttgctggctgaattgtga

SEQ ID NO: 30576 - DNA, 24 bp, Artificial Sequence
  Synthetic Construct
cctggaaacagcttgcttgtgaag

SEQ ID NO: 30577 - DNA, 24 bp, Artificial Sequence
  Synthetic Construct
tgccttttattcagtcctgaggtt

SEQ ID NO: 30578 - DNA, 22 bp, Artificial Sequence
  Synthetic Construct
gtaaagcccgggtcctaacatt

SEQ ID NO: 30579 - DNA, 26 bp, Artificial Sequence
  Synthetic Construct
cctgtaagatgtctgagtggacaatg

SEQ ID NO: 30580 - DNA, 20 bp, Artificial Sequence
  Synthetic Construct
ggccagcaatctggctttca

SEQ ID NO: 30581 - DNA, 24 bp, Artificial Sequence
  Synthetic Construct
acccaccttcctctgtaactatct

SEQ ID NO: 30582 - DNA, 25 bp, Artificial Sequence
  Synthetic Construct
aaagcagtttcttaccctgtgagat

SEQ ID NO: 30583 - DNA, 22 bp, Artificial Sequence
  Synthetic Construct
tgtgcaaaagggcttgcttatc

SEQ ID NO: 30584 - DNA, 24 bp, Artificial Sequence
  Synthetic Construct
atgtggtctcaaatagctccaaca

SEQ ID NO: 30585 - DNA, 21 bp, Artificial Sequence
  Synthetic Construct
ggccacatgcaggaacaaatg

SEQ ID NO: 30586 - DNA, 22 bp, Artificial Sequence
  Synthetic Construct
cctcttcatctcctggctcaca

SEQ ID NO: 30587 - DNA, 21 bp, Artificial Sequence
  Synthetic Construct
cttgctggagggtcactgtag

SEQ ID NO: 30588 - DNA, 26 bp, Artificial Sequence
  Synthetic Construct
gagaatgcatctcccttggaaatagt

SEQ ID NO: 30589 - DNA, 25 bp, Artificial Sequence
  Synthetic Construct
ccgtgtggttttaccatccttcaac

SEQ ID NO: 30590 - DNA, 27 bp, Artificial Sequence
  Synthetic Construct
cactaaaaggtgtgacaggagtataga

SEQ ID NO: 30591 - DNA, 22 bp, Artificial Sequence
  Synthetic Construct
tcccacccaccatgagaactac

SEQ ID NO: 30592 - DNA, 20 bp, Artificial Sequence
  Synthetic Construct
gcagctacctctccgtctca

SEQ ID NO: 30593 - DNA, 27 bp, Artificial Sequence
  Synthetic Construct
gctgttcttgtctacacagttttctac

SEQ ID NO: 30594 - DNA, 22 bp, Artificial Sequence
  Synthetic Construct
gcggggaaaagagaaccatttg

SEQ ID NO: 30595 - DNA, 25 bp, Artificial Sequence
  Synthetic Construct
tgctctattcaaagtgtgactgtct

SEQ ID NO: 30596 - DNA, 21 bp, Artificial Sequence
  Synthetic Construct
gcccacctcactggagcaaaa

SEQ ID NO: 30597 - DNA, 26 bp, Artificial Sequence
  Synthetic Construct
ccagacaggctgttcaaagaggatac

SEQ ID NO: 30598 - DNA, 22 bp, Artificial Sequence
  Synthetic Construct
acccttgtcagggtacggtcaa

SEQ ID NO: 30599 - DNA, 20 bp, Artificial Sequence
  Synthetic Construct
ataagagccggcccagaact

SEQ ID NO: 30600 - DNA, 21 bp, Artificial Sequence
  Synthetic Construct
acatgtgcgcttctggagttc

SEQ ID NO: 30601 - DNA, 24 bp, Artificial Sequence
  Synthetic Construct
ggactggacctcagtgttgctcta

SEQ ID NO: 30602 - DNA, 22 bp, Artificial Sequence
  Synthetic Construct
gcgagaggggaattgctgaatg

SEQ ID NO: 30603 - DNA, 20 bp, Artificial Sequence
  Synthetic Construct
ttgggaggtgggtcggctaa

SEQ ID NO: 30604 - DNA, 22 bp, Artificial Sequence
  Synthetic Construct
ccagaggacaccaacgatcaga

SEQ ID NO: 30605 - DNA, 23 bp, Artificial Sequence
  Synthetic Construct
tgtatatttgtgcgctccacgta

SEQ ID NO: 30606 - DNA, 25 bp, Artificial Sequence
  Synthetic Construct
gcaatcaggtgtttctcactctaac

SEQ ID NO: 30607 - DNA, 19 bp, Artificial Sequence
  Synthetic Construct
gcagtggggtgtccagcaa

SEQ ID NO: 30608 - DNA, 24 bp, Artificial Sequence
  Synthetic Construct
tctctctagaccaacccacattct

SEQ ID NO: 30609 - DNA, 26 bp, Artificial Sequence
  Synthetic Construct
ggactactgtttctcttcaccaacta

SEQ ID NO: 30610 - DNA, 25 bp, Artificial Sequence
  Synthetic Construct
cccagagataagatcacgccatcaa

SEQ ID NO: 30611 - DNA, 25 bp, Artificial Sequence
  Synthetic Construct
tggccgtggggttatataagtttag

SEQ ID NO: 30612 - DNA, 21 bp, Artificial Sequence
  Synthetic Construct
tcaccccttgcaggaccctta

SEQ ID NO: 30613 - DNA, 24 bp, Artificial Sequence
  Synthetic Construct
cactcctgtttagtctccaggttt

SEQ ID NO: 30614 - DNA, 27 bp, Artificial Sequence
  Synthetic Construct
cctccattctctctgactgggatgaac

SEQ ID NO: 30615 - DNA, 25 bp, Artificial Sequence
  Synthetic Construct
tgggtcaaagattaccaaacactga

SEQ ID NO: 30616 - DNA, 26 bp, Artificial Sequence
  Synthetic Construct
ctccttactcacttgtctgactgaag

SEQ ID NO: 30617 - DNA, 21 bp, Artificial Sequence
  Synthetic Construct
gctgaggcattttgggacaga

SEQ ID NO: 30618 - DNA, 22 bp, Artificial Sequence
  Synthetic Construct
ggtgacccagagacccaagaaa

SEQ ID NO: 30619 - DNA, 30 bp, Artificial Sequence
  Synthetic Construct
gactgagagcaagacaggatagatgatact

SEQ ID NO: 30620 - DNA, 19 bp, Artificial Sequence
  Synthetic Construct
ggggcattgcctccttgaa

SEQ ID NO: 30621 - DNA, 26 bp, Artificial Sequence
  Synthetic Construct
cacagaaaggcatggtcagaaaaatc

SEQ ID NO: 30622 - DNA, 24 bp, Artificial Sequence
  Synthetic Construct
gcccctggtttcatgacagtgttc

SEQ ID NO: 30623 - DNA, 26 bp, Artificial Sequence
  Synthetic Construct
cgaagtatcattttccccagtagtca

SEQ ID NO: 30624 - DNA, 21 bp, Artificial Sequence
  Synthetic Construct
ctcttcatcgcaccagcaact

SEQ ID NO: 30625 - DNA, 26 bp, Artificial Sequence
  Synthetic Construct
catgcagtaatccaggaaaccatttg

SEQ ID NO: 30626 - DNA, 21 bp, Artificial Sequence
  Synthetic Construct
agccttttggggtccactttg

SEQ ID NO: 30627 - DNA, 23 bp, Artificial Sequence
  Synthetic Construct
tcagcaaatggactcagacaact

SEQ ID NO: 30628 - DNA, 22 bp, Artificial Sequence
  Synthetic Construct
ctaatccctccagcctctcctt

SEQ ID NO: 30629 - DNA, 20 bp, Artificial Sequence
  Synthetic Construct
gggagctgctttgcatgagt

SEQ ID NO: 30630 - DNA, 21 bp, Artificial Sequence
  Synthetic Construct
ggcaaacttctggagggacaa

SEQ ID NO: 30631 - DNA, 24 bp, Artificial Sequence
  Synthetic Construct
tcctgttacagtagccaaaagcat

SEQ ID NO: 30632 - DNA, 23 bp, Artificial Sequence
  Synthetic Construct
gagctaccaaccttctccacctt

SEQ ID NO: 30633 - DNA, 24 bp, Artificial Sequence
  Synthetic Construct
gaaatcagctcacccattgctact

SEQ ID NO: 30634 - DNA, 24 bp, Artificial Sequence
  Synthetic Construct
gaacttaaggagtcgatggtcgtt

SEQ ID NO: 30635 - DNA, 25 bp, Artificial Sequence
  Synthetic Construct
gccacagacatcactaatgaacaca

SEQ ID NO: 30636 - DNA, 25 bp, Artificial Sequence
  Synthetic Construct
gaggagcttgcataatggggagtag

SEQ ID NO: 30637 - DNA, 26 bp, Artificial Sequence
  Synthetic Construct
ggtcactgttaggcaagaagccatac

SEQ ID NO: 30638 - DNA, 27 bp, Artificial Sequence
  Synthetic Construct
cctatacatgcagcttaacatgtgact

SEQ ID NO: 30639 - DNA, 27 bp, Artificial Sequence
  Synthetic Construct
ggtggcatagttttactaggttcaaca

SEQ ID NO: 30640 - DNA, 23 bp, Artificial Sequence
  Synthetic Construct
cactcccctgtccatgctacttt

SEQ ID NO: 30641 - DNA, 22 bp, Artificial Sequence
  Synthetic Construct
ggagaccgtcctgtgatactgt

SEQ ID NO: 30642 - DNA, 22 bp, Artificial Sequence
  Synthetic Construct
ggtcagcaacaggagctcaaga

SEQ ID NO: 30643 - DNA, 21 bp, Artificial Sequence
  Synthetic Construct
tgaatggaaacccgtgctgta

SEQ ID NO: 30644 - DNA, 24 bp, Artificial Sequence
  Synthetic Construct
aatgcaggagacctcacattttct

SEQ ID NO: 30645 - DNA, 22 bp, Artificial Sequence
  Synthetic Construct
ggtttcttccagcctgcaatgt

SEQ ID NO: 30646 - DNA, 19 bp, Artificial Sequence
  Synthetic Construct
agggcactgacggctgctt

SEQ ID NO: 30647 - DNA, 21 bp, Artificial Sequence
  Synthetic Construct
agcactgcacacaagacaagt

SEQ ID NO: 30648 - DNA, 24 bp, Artificial Sequence
  Synthetic Construct
aagtgaatttcctggcaccttttc

SEQ ID NO: 30649 - DNA, 24 bp, Artificial Sequence
  Synthetic Construct
cttcccatgtttaggatgggttgt

SEQ ID NO: 30650 - DNA, 19 bp, Artificial Sequence
  Synthetic Construct
ccccacagggtcagcttct

SEQ ID NO: 30651 - DNA, 22 bp, Artificial Sequence
  Synthetic Construct
ggaaggggcagtggttcagatg

SEQ ID NO: 30652 - DNA, 25 bp, Artificial Sequence
  Synthetic Construct
aggtaagtgacagtttgctctttga

SEQ ID NO: 30653 - DNA, 22 bp, Artificial Sequence
  Synthetic Construct
cagagccatttcctcagcgtaa

SEQ ID NO: 30654 - DNA, 23 bp, Artificial Sequence
  Synthetic Construct
tgctctgagacaatgcaaagtga

SEQ ID NO: 30655 - DNA, 23 bp, Artificial Sequence
  Synthetic Construct
gggcagtaggaggagacttatct

SEQ ID NO: 30656 - DNA, 23 bp, Artificial Sequence
  Synthetic Construct
ggcctcacacaatgacaggaact

SEQ ID NO: 30657 - DNA, 23 bp, Artificial Sequence
  Synthetic Construct
cgcccacaagtcatgaagcaaac

SEQ ID NO: 30658 - DNA, 24 bp, Artificial Sequence
  Synthetic Construct
gccggaagactcagcaagtctagt

SEQ ID NO: 30659 - DNA, 24 bp, Artificial Sequence
  Synthetic Construct
gactcctttctgaaggactgtgaa

SEQ ID NO: 30660 - DNA, 22 bp, Artificial Sequence
  Synthetic Construct
ccaggaggcaagcaggtagttt

SEQ ID NO: 30661 - DNA, 22 bp, Artificial Sequence
  Synthetic Construct
ctcccaggctctgagaatgaca

SEQ ID NO: 30662 - DNA, 25 bp, Artificial Sequence
  Synthetic Construct
ggggtagaatccaggcattgggaat

SEQ ID NO: 30663 - DNA, 23 bp, Artificial Sequence
  Synthetic Construct
acggtgtctaagaatgagcttgt

SEQ ID NO: 30664 - DNA, 22 bp, Artificial Sequence
  Synthetic Construct
ggggcagattccgttccattca

SEQ ID NO: 30665 - DNA, 26 bp, Artificial Sequence
  Synthetic Construct
cccttctctactcagaatggaacagt

SEQ ID NO: 30666 - DNA, 23 bp, Artificial Sequence
  Synthetic Construct
ctaggcatggcatggtaaacaag

SEQ ID NO: 30667 - DNA, 23 bp, Artificial Sequence
  Synthetic Construct
gcaaacagtaagcagctttgaga

SEQ ID NO: 30668 - DNA, 27 bp, Artificial Sequence
  Synthetic Construct
cttgagattttctcaggctcttgaatc

SEQ ID NO: 30669 - DNA, 29 bp, Artificial Sequence
  Synthetic Construct
ctccctaagtgtttttatgggtctctgaa

SEQ ID NO: 30670 - DNA, 26 bp, Artificial Sequence
  Synthetic Construct
cttgaaagctttatgaccaggcttag

SEQ ID NO: 30671 - DNA, 22 bp, Artificial Sequence
  Synthetic Construct
gggacactcactgcctttggtt

SEQ ID NO: 30672 - DNA, 24 bp, Artificial Sequence
  Synthetic Construct
acctgcttcagatcctacaggaaa

SEQ ID NO: 30673 - DNA, 21 bp, Artificial Sequence
  Synthetic Construct
ttggggcaccgagggatttgt

SEQ ID NO: 30674 - DNA, 23 bp, Artificial Sequence
  Synthetic Construct
ttgtaaaccgtgagggagagatg

SEQ ID NO: 30675 - DNA, 21 bp, Artificial Sequence
  Synthetic Construct
gttcatgctgatgcccgtttg

SEQ ID NO: 30676 - DNA, 19 bp, Artificial Sequence
  Synthetic Construct
aggtggaggccaggaccat

SEQ ID NO: 30677 - DNA, 27 bp, Artificial Sequence
  Synthetic Construct
tggtaggtaccaaataggaaagtcttg

SEQ ID NO: 30678 - DNA, 23 bp, Artificial Sequence
  Synthetic Construct
gccatgtgaagtcagtcctgtga

SEQ ID NO: 30679 - DNA, 21 bp, Artificial Sequence
  Synthetic Construct
ttccacggactgctcggagat

SEQ ID NO: 30680 - DNA, 24 bp, Artificial Sequence
  Synthetic Construct
ggtctcaggcacctaaacctcttc

SEQ ID NO: 30681 - DNA, 22 bp, Artificial Sequence
  Synthetic Construct
tgcagagactggcacctgtaac

SEQ ID NO: 30682 - DNA, 24 bp, Artificial Sequence
  Synthetic Construct
ggtctacatcttggttgccacttc

SEQ ID NO: 30683 - DNA, 25 bp, Artificial Sequence
  Synthetic Construct
ctggatcactgaagtcaggaggaaa

SEQ ID NO: 30684 - DNA, 25 bp, Artificial Sequence
  Synthetic Construct
cagctatatgctgagggttgacagt

SEQ ID NO: 30685 - DNA, 29 bp, Artificial Sequence
  Synthetic Construct
gcagctattttcaaagaccccttttcaag

SEQ ID NO: 30686 - DNA, 26 bp, Artificial Sequence
  Synthetic Construct
gaggatcacatcagactgtgttagtt

SEQ ID NO: 30687 - DNA, 23 bp, Artificial Sequence
  Synthetic Construct
gcctttgagctgcagatttcaca

SEQ ID NO: 30688 - DNA, 22 bp, Artificial Sequence
  Synthetic Construct
tcatgacccaggctctctccta

SEQ ID NO: 30689 - DNA, 23 bp, Artificial Sequence
  Synthetic Construct
ggcatttggtacctcacgtgctt

SEQ ID NO: 30690 - DNA, 22 bp, Artificial Sequence
  Synthetic Construct
agggctaggagtgggtgtcatt

SEQ ID NO: 30691 - DNA, 21 bp, Artificial Sequence
  Synthetic Construct
ggtgtcaccctcctcccaaga

SEQ ID NO: 30692 - DNA, 25 bp, Artificial Sequence
  Synthetic Construct
tgagaatactacccacaagggtctt

SEQ ID NO: 30693 - DNA, 23 bp, Artificial Sequence
  Synthetic Construct
gtcttgggaagacccgatcatct

SEQ ID NO: 30694 - DNA, 25 bp, Artificial Sequence
  Synthetic Construct
gaactgggagctcctacaaatacat

SEQ ID NO: 30695 - DNA, 23 bp, Artificial Sequence
  Synthetic Construct
agggatacctgggagctgtcatc

SEQ ID NO: 30696 - DNA, 23 bp, Artificial Sequence
  Synthetic Construct
gccaagtctgcattccactgtgt

SEQ ID NO: 30697 - DNA, 24 bp, Artificial Sequence
  Synthetic Construct
cctgtgtctcggtctcacctatca

SEQ ID NO: 30698 - DNA, 25 bp, Artificial Sequence
  Synthetic Construct
cccacacttctagatcctgctgttg

SEQ ID NO: 30699 - DNA, 21 bp, Artificial Sequence
  Synthetic Construct
gtcccctcccctaaggagtca

SEQ ID NO: 30700 - DNA, 21 bp, Artificial Sequence
  Synthetic Construct
gcacgccaagttctcggatgt

SEQ ID NO: 30701 - DNA, 25 bp, Artificial Sequence
  Synthetic Construct
ccatgggatggagccactacagaaa

SEQ ID NO: 30702 - DNA, 22 bp, Artificial Sequence
  Synthetic Construct
gagccagggaggtggaagaaat

SEQ ID NO: 30703 - DNA, 27 bp, Artificial Sequence
  Synthetic Construct
gaagtgaacagagagtttcatgtcaga

SEQ ID NO: 30704 - DNA, 26 bp, Artificial Sequence
  Synthetic Construct
gaggggaggaggcttttattttcttg

SEQ ID NO: 30705 - DNA, 21 bp, Artificial Sequence
  Synthetic Construct
accgttccccttctcccttgt

SEQ ID NO: 30706 - DNA, 23 bp, Artificial Sequence
  Synthetic Construct
ccataggtaggtgggcaaacaca

SEQ ID NO: 30707 - DNA, 20 bp, Artificial Sequence
  Synthetic Construct
gcagtgctgtggctgtgaag

SEQ ID NO: 30708 - DNA, 26 bp, Artificial Sequence
  Synthetic Construct
gggcttagatgacgacattgttggtt

SEQ ID NO: 30709 - DNA, 25 bp, Artificial Sequence
  Synthetic Construct
ccagagcactgggtaaaatgcttag

SEQ ID NO: 30710 - DNA, 21 bp, Artificial Sequence
  Synthetic Construct
ttgggatgcctctccttggta

SEQ ID NO: 30711 - DNA, 25 bp, Artificial Sequence
  Synthetic Construct
ccctcccattaagcagaggtgaact

SEQ ID NO: 30712 - DNA, 22 bp, Artificial Sequence
  Synthetic Construct
tgcagtctccagtaggctgtga

SEQ ID NO: 30713 - DNA, 21 bp, Artificial Sequence
  Synthetic Construct
cagtgctgaacacacctgaga

SEQ ID NO: 30714 - DNA, 22 bp, Artificial Sequence
  Synthetic Construct
atcatgcccctcctctatcact

SEQ ID NO: 30715 - DNA, 21 bp, Artificial Sequence
  Synthetic Construct
gccccggtaacgaggttttct

SEQ ID NO: 30716 - DNA, 27 bp, Artificial Sequence
  Synthetic Construct
ggtcatacgttaaggacatgtttcact

SEQ ID NO: 30717 - DNA, 27 bp, Artificial Sequence
  Synthetic Construct
cttcacattttcccagctagactgaat

SEQ ID NO: 30718 - DNA, 21 bp, Artificial Sequence
  Synthetic Construct
ggtgcctccaaaagccttgta

SEQ ID NO: 30719 - DNA, 20 bp, Artificial Sequence
  Synthetic Construct
gcccacctgatcacaaccat

SEQ ID NO: 30720 - DNA, 25 bp, Artificial Sequence
  Synthetic Construct
gagttgtgtagctgactagacttca

SEQ ID NO: 30721 - DNA, 22 bp, Artificial Sequence
  Synthetic Construct
gcacaatgccatgtgggaggaa

SEQ ID NO: 30722 - DNA, 21 bp, Artificial Sequence
  Synthetic Construct
aaccaagcctgagtcctctct

SEQ ID NO: 30723 - DNA, 22 bp, Artificial Sequence
  Synthetic Construct
aggcagaccactaactggagaa

SEQ ID NO: 30724 - DNA, 25 bp, Artificial Sequence
  Synthetic Construct
ctggggcttactacagcttgaaaac

SEQ ID NO: 30725 - DNA, 23 bp, Artificial Sequence
  Synthetic Construct
cattggacacactcaggtaggtt

SEQ ID NO: 30726 - DNA, 22 bp, Artificial Sequence
  Synthetic Construct
agtgtgggccttctgtatcact

SEQ ID NO: 30727 - DNA, 23 bp, Artificial Sequence
  Synthetic Construct
gccccactgagggaaatgttttg

SEQ ID NO: 30728 - DNA, 26 bp, Artificial Sequence
  Synthetic Construct
tgtgttatggacctgtctatctctga

SEQ ID NO: 30729 - DNA, 28 bp, Artificial Sequence
  Synthetic Construct
gtggtgtcctgattttcctattgggttt

SEQ ID NO: 30730 - DNA, 24 bp, Artificial Sequence
  Synthetic Construct
ggctgtctccaaagcaaggtgaac

SEQ ID NO: 30731 - DNA, 20 bp, Artificial Sequence
  Synthetic Construct
ggacaagacccactgtgcaa

SEQ ID NO: 30732 - DNA, 20 bp, Artificial Sequence
  Synthetic Construct
ttgcccctctccatgctttc

SEQ ID NO: 30733 - DNA, 20 bp, Artificial Sequence
  Synthetic Construct
gagcaccaagccccattagt

SEQ ID NO: 30734 - DNA, 21 bp, Artificial Sequence
  Synthetic Construct
cctgctgtgaccaggaagtca

SEQ ID NO: 30735 - DNA, 26 bp, Artificial Sequence
  Synthetic Construct
ccttttcctgtctctcaggcctattc

SEQ ID NO: 30736 - DNA, 20 bp, Artificial Sequence
  Synthetic Construct
agcaggcccttctggactat

SEQ ID NO: 30737 - DNA, 25 bp, Artificial Sequence
  Synthetic Construct
gaggggaatggtttaccttcgtcaa

SEQ ID NO: 30738 - DNA, 22 bp, Artificial Sequence
  Synthetic Construct
cctggtgcagggagacatttac

SEQ ID NO: 30739 - DNA, 20 bp, Artificial Sequence
  Synthetic Construct
gggctgtgcacattccagta

SEQ ID NO: 30740 - DNA, 25 bp, Artificial Sequence
  Synthetic Construct
acactaaatggtctccctgatcctt

SEQ ID NO: 30741 - DNA, 26 bp, Artificial Sequence
  Synthetic Construct
gcaagtaagaatgggtttgagtcagt

SEQ ID NO: 30742 - DNA, 27 bp, Artificial Sequence
  Synthetic Construct
cccacagcaatatgtcagaaacgataa

SEQ ID NO: 30743 - DNA, 25 bp, Artificial Sequence
  Synthetic Construct
tgctgaatcttgctaggattgactt

SEQ ID NO: 30744 - DNA, 26 bp, Artificial Sequence
  Synthetic Construct
cacatgaaacacacacagactgattc

SEQ ID NO: 30745 - DNA, 19 bp, Artificial Sequence
  Synthetic Construct
ggtctggggacagccaagt

SEQ ID NO: 30746 - DNA, 25 bp, Artificial Sequence
  Synthetic Construct
gcacagagacataggacttggtgtt

SEQ ID NO: 30747 - DNA, 20 bp, Artificial Sequence
  Synthetic Construct
gatgcccatctggacgtgat

SEQ ID NO: 30748 - DNA, 24 bp, Artificial Sequence
  Synthetic Construct
gccctgcctcagaaaagtccattc

SEQ ID NO: 30749 - DNA, 22 bp, Artificial Sequence
  Synthetic Construct
gccaaatgcttgaggtttgctt

SEQ ID NO: 30750 - DNA, 23 bp, Artificial Sequence
  Synthetic Construct
gccgttgcagtgattgtaattct

SEQ ID NO: 30751 - DNA, 23 bp, Artificial Sequence
  Synthetic Construct
actaggagcccttctctttccaa

SEQ ID NO: 30752 - DNA, 24 bp, Artificial Sequence
  Synthetic Construct
ccactagcgtaggacagtcattct

SEQ ID NO: 30753 - DNA, 20 bp, Artificial Sequence
  Synthetic Construct
ctcctgtggtggtgatgctt

SEQ ID NO: 30754 - DNA, 26 bp, Artificial Sequence
  Synthetic Construct
ccccaagtctcggtcttttatttaca

SEQ ID NO: 30755 - DNA, 24 bp, Artificial Sequence
  Synthetic Construct
cccagagaatggacagtttacaga

SEQ ID NO: 30756 - DNA, 21 bp, Artificial Sequence
  Synthetic Construct
gcatgggcttcccatccacat

SEQ ID NO: 30757 - DNA, 24 bp, Artificial Sequence
  Synthetic Construct
ggtatttgcaagttcccgaatcaa

SEQ ID NO: 30758 - DNA, 20 bp, Artificial Sequence
  Synthetic Construct
ctgcctcccatagggctagt

SEQ ID NO: 30759 - DNA, 27 bp, Artificial Sequence
  Synthetic Construct
cacttatgtcccctaccaaacccatac

SEQ ID NO: 30760 - DNA, 21 bp, Artificial Sequence
  Synthetic Construct
gggtgggagcgcctattcttg

SEQ ID NO: 30761 - DNA, 23 bp, Artificial Sequence
  Synthetic Construct
gcgttcgaagcactctacacact

SEQ ID NO: 30762 - DNA, 24 bp, Artificial Sequence
  Synthetic Construct
cactgagttccaccagttcaaaca

SEQ ID NO: 30763 - DNA, 20 bp, Artificial Sequence
  Synthetic Construct
tccagcccaacacctcatca

SEQ ID NO: 30764 - DNA, 20 bp, Artificial Sequence
  Synthetic Construct
agtgacagccccatcactgt

SEQ ID NO: 30765 - DNA, 26 bp, Artificial Sequence
  Synthetic Construct
cctgagggtacatttctcacagatac

SEQ ID NO: 30766 - DNA, 25 bp, Artificial Sequence
  Synthetic Construct
gcagacatttggcattagaggaagt

SEQ ID NO: 30767 - DNA, 26 bp, Artificial Sequence
  Synthetic Construct
ctttctgtgattactgtggtgagatg

SEQ ID NO: 30768 - DNA, 20 bp, Artificial Sequence
  Synthetic Construct
gcgtgttcaggagcaagaca

SEQ ID NO: 30769 - DNA, 21 bp, Artificial Sequence
  Synthetic Construct
tgcttttggtgtgtccagtga

SEQ ID NO: 30770 - DNA, 23 bp, Artificial Sequence
  Synthetic Construct
caaaactgctcctggtggagaac

SEQ ID NO: 30771 - DNA, 24 bp, Artificial Sequence
  Synthetic Construct
ctgtactgcccaagatgagctttc

SEQ ID NO: 30772 - DNA, 21 bp, Artificial Sequence
  Synthetic Construct
ggtcctgggctgattttctga

SEQ ID NO: 30773 - DNA, 26 bp, Artificial Sequence
  Synthetic Construct
ggacaggcagagacaaaggaaagaag

SEQ ID NO: 30774 - DNA, 22 bp, Artificial Sequence
  Synthetic Construct
cttttgcacccaggactctgaa

SEQ ID NO: 30775 - DNA, 20 bp, Artificial Sequence
  Synthetic Construct
tgggtggctcagactgtcaa

SEQ ID NO: 30776 - DNA, 20 bp, Artificial Sequence
  Synthetic Construct
tgccacagggagaaggaagt

SEQ ID NO: 30777 - DNA, 25 bp, Artificial Sequence
  Synthetic Construct
cgaaagtaaatgctaagccttgcta

SEQ ID NO: 30778 - DNA, 21 bp, Artificial Sequence
  Synthetic Construct
ccctcttgccacagtgccttt

SEQ ID NO: 30779 - DNA, 25 bp, Artificial Sequence
  Synthetic Construct
gtggagtagagcccttctgaataac

SEQ ID NO: 30780 - DNA, 23 bp, Artificial Sequence
  Synthetic Construct
gagagggaagatttgtgggtgtt

SEQ ID NO: 30781 - DNA, 22 bp, Artificial Sequence
  Synthetic Construct
gcctgcaggattcaaacccaat

SEQ ID NO: 30782 - DNA, 22 bp, Artificial Sequence
  Synthetic Construct
gagagcagggaacatgggttct

SEQ ID NO: 30783 - DNA, 23 bp, Artificial Sequence
  Synthetic Construct
ggaacttaaccccgctccctttc

SEQ ID NO: 30784 - DNA, 23 bp, Artificial Sequence
  Synthetic Construct
aagtgctacaacggaaaggaagt

SEQ ID NO: 30785 - DNA, 23 bp, Artificial Sequence
  Synthetic Construct
gctccaagagaccctgactcact

SEQ ID NO: 30786 - DNA, 20 bp, Artificial Sequence
  Synthetic Construct
ctgggcagagcactgaaagt

SEQ ID NO: 30787 - DNA, 24 bp, Artificial Sequence
  Synthetic Construct
gtcgaggttgatttcgagtcacta

SEQ ID NO: 30788 - DNA, 25 bp, Artificial Sequence
  Synthetic Construct
gtgacaagatgtcattgccaaccaa

SEQ ID NO: 30789 - DNA, 22 bp, Artificial Sequence
  Synthetic Construct
acaaccagcccttgcattaact

SEQ ID NO: 30790 - DNA, 24 bp, Artificial Sequence
  Synthetic Construct
gattgaagcccagccttgaataag

SEQ ID NO: 30791 - DNA, 25 bp, Artificial Sequence
  Synthetic Construct
agggccaaagatgaagaatgtagtt

SEQ ID NO: 30792 - DNA, 20 bp, Artificial Sequence
  Synthetic Construct
gcttgggtggtggtggaaca

SEQ ID NO: 30793 - DNA, 23 bp, Artificial Sequence
  Synthetic Construct
cagagttgcaaggtacccattct

SEQ ID NO: 30794 - DNA, 22 bp, Artificial Sequence
  Synthetic Construct
ctgtcacctggcgtacagaaat

SEQ ID NO: 30795 - DNA, 23 bp, Artificial Sequence
  Synthetic Construct
ccactaccccttactccacttga

SEQ ID NO: 30796 - DNA, 18 bp, Artificial Sequence
  Synthetic Construct
ccccacggaacactgcat

SEQ ID NO: 30797 - DNA, 21 bp, Artificial Sequence
  Synthetic Construct
ttccctggggctcagactgtt

SEQ ID NO: 30798 - DNA, 27 bp, Artificial Sequence
  Synthetic Construct
acagcttccctgtaggaagttataaag

SEQ ID NO: 30799 - DNA, 26 bp, Artificial Sequence
  Synthetic Construct
gtgaagaccaggtatggcttttcaag

SEQ ID NO: 30800 - DNA, 21 bp, Artificial Sequence
  Synthetic Construct
ccccatcaggcagggaaaaca

SEQ ID NO: 30801 - DNA, 23 bp, Artificial Sequence
  Synthetic Construct
cggactggactataagggcaaca

SEQ ID NO: 30802 - DNA, 30 bp, Artificial Sequence
  Synthetic Construct
ggaagacactgtgcttacttaacttgtttg

SEQ ID NO: 30803 - DNA, 25 bp, Artificial Sequence
  Synthetic Construct
tttctccctcccctattacaaggat

SEQ ID NO: 30804 - DNA, 24 bp, Artificial Sequence
  Synthetic Construct
cctgagggtggaaccaaatatgta

SEQ ID NO: 30805 - DNA, 25 bp, Artificial Sequence
  Synthetic Construct
cttattggtgcaagccatgtttagt

SEQ ID NO: 30806 - DNA, 22 bp, Artificial Sequence
  Synthetic Construct
ccctcaacagcaccgagtctat

SEQ ID NO: 30807 - DNA, 21 bp, Artificial Sequence
  Synthetic Construct
acacacacaagccatccagaa

SEQ ID NO: 30808 - DNA, 22 bp, Artificial Sequence
  Synthetic Construct
accgtttgggaggctatttgaa

SEQ ID NO: 30809 - DNA, 27 bp, Artificial Sequence
  Synthetic Construct
gctaggaatcaccaatttttgccctaa

SEQ ID NO: 30810 - DNA, 25 bp, Artificial Sequence
  Synthetic Construct
tctacttgtcttgccatgcacataa

SEQ ID NO: 30811 - DNA, 27 bp, Artificial Sequence
  Synthetic Construct
ctttattccatccatcttgccctaaag

SEQ ID NO: 30812 - DNA, 22 bp, Artificial Sequence
  Synthetic Construct
cccaccaacccaagagtcttct

SEQ ID NO: 30813 - DNA, 24 bp, Artificial Sequence
  Synthetic Construct
tgcccaaagtcacataggaatgat

SEQ ID NO: 30814 - DNA, 21 bp, Artificial Sequence
  Synthetic Construct
acgagaggggaagggagaaga

SEQ ID NO: 30815 - DNA, 22 bp, Artificial Sequence
  Synthetic Construct
ctgctgtacaggtctgcgacaa

SEQ ID NO: 30816 - DNA, 24 bp, Artificial Sequence
  Synthetic Construct
tgctgatagctcagaatctgcatt

SEQ ID NO: 30817 - DNA, 19 bp, Artificial Sequence
  Synthetic Construct
accaccaggctggggatct

SEQ ID NO: 30818 - DNA, 21 bp, Artificial Sequence
  Synthetic Construct
aggctacaggggtctgcaatg

SEQ ID NO: 30819 - DNA, 22 bp, Artificial Sequence
  Synthetic Construct
ggctaaatcacggggtcaaaac

SEQ ID NO: 30820 - DNA, 27 bp, Artificial Sequence
  Synthetic Construct
tcagagattctgagtaatcccagtttg

SEQ ID NO: 30821 - DNA, 22 bp, Artificial Sequence
  Synthetic Construct
gctccccagtgtttttgagaga

SEQ ID NO: 30822 - DNA, 22 bp, Artificial Sequence
  Synthetic Construct
cctcagtctcctgagcctttgt

SEQ ID NO: 30823 - DNA, 24 bp, Artificial Sequence
  Synthetic Construct
ggagttgactccaattgtcctaca

SEQ ID NO: 30824 - DNA, 25 bp, Artificial Sequence
  Synthetic Construct
gctggatcactaaccaccactcctt

SEQ ID NO: 30825 - DNA, 30 bp, Artificial Sequence
  Synthetic Construct
gactgcagtgtcagaatttcataacccaaa

SEQ ID NO: 30826 - DNA, 24 bp, Artificial Sequence
  Synthetic Construct
cagattgaatggaggttgctctgt

SEQ ID NO: 30827 - DNA, 25 bp, Artificial Sequence
  Synthetic Construct
ggttttcccctggatagggagtcta

SEQ ID NO: 30828 - DNA, 20 bp, Artificial Sequence
  Synthetic Construct
aggtggcaggacgcacttag

SEQ ID NO: 30829 - DNA, 23 bp, Artificial Sequence
  Synthetic Construct
ctgttgcgtacaagggagctcta

SEQ ID NO: 30830 - DNA, 25 bp, Artificial Sequence
  Synthetic Construct
gaataaccaacggagtggttttcat

SEQ ID NO: 30831 - DNA, 22 bp, Artificial Sequence
  Synthetic Construct
gctccataagggcagggacaaa

SEQ ID NO: 30832 - DNA, 25 bp, Artificial Sequence
  Synthetic Construct
gggccagaatccagtcttctgactt

SEQ ID NO: 30833 - DNA, 23 bp, Artificial Sequence
  Synthetic Construct
gcaccttcccagtccacctgtat

SEQ ID NO: 30834 - DNA, 22 bp, Artificial Sequence
  Synthetic Construct
cacccagctttggctcttatca

SEQ ID NO: 30835 - DNA, 22 bp, Artificial Sequence
  Synthetic Construct
caacaagctgcagtcaactcaa

SEQ ID NO: 30836 - DNA, 22 bp, Artificial Sequence
  Synthetic Construct
aatgcacatggagtctgggaaa

SEQ ID NO: 30837 - DNA, 22 bp, Artificial Sequence
  Synthetic Construct
ggaaagcccttgtgcacataca

SEQ ID NO: 30838 - DNA, 22 bp, Artificial Sequence
  Synthetic Construct
ggggtttgcagcagggagttta

SEQ ID NO: 30839 - DNA, 24 bp, Artificial Sequence
  Synthetic Construct
gctaacccagacctatgaggaaac

SEQ ID NO: 30840 - DNA, 22 bp, Artificial Sequence
  Synthetic Construct
ctgaaagcaaggaggcttccaa

SEQ ID NO: 30841 - DNA, 20 bp, Artificial Sequence
  Synthetic Construct
gccaggttgcatctctgtgt

SEQ ID NO: 30842 - DNA, 25 bp, Artificial Sequence
  Synthetic Construct
agggaagtaagcatccagaactttg

SEQ ID NO: 30843 - DNA, 24 bp, Artificial Sequence
  Synthetic Construct
ggttttccgcctaggaaaagagat

SEQ ID NO: 30844 - DNA, 27 bp, Artificial Sequence
  Synthetic Construct
cctcttttctctacactggagttttca

SEQ ID NO: 30845 - DNA, 27 bp, Artificial Sequence
  Synthetic Construct
cagcatggacagatcattaagggagaa

SEQ ID NO: 30846 - DNA, 22 bp, Artificial Sequence
  Synthetic Construct
gcttcacccctggtggctatta

SEQ ID NO: 30847 - DNA, 22 bp, Artificial Sequence
  Synthetic Construct
gtgaatgttgggtaggcgttca

SEQ ID NO: 30848 - DNA, 23 bp, Artificial Sequence
  Synthetic Construct
tggtctgggcaaagatttcttga

SEQ ID NO: 30849 - DNA, 22 bp, Artificial Sequence
  Synthetic Construct
gggccacacatttcctcatttg

SEQ ID NO: 30850 - DNA, 27 bp, Artificial Sequence
  Synthetic Construct
gcttgagtttacactccttttctcttc

SEQ ID NO: 30851 - DNA, 22 bp, Artificial Sequence
  Synthetic Construct
gcacatcctgccctttgctgaa

SEQ ID NO: 30852 - DNA, 20 bp, Artificial Sequence
  Synthetic Construct
gtcctacaggtgggctcgaa

SEQ ID NO: 30853 - DNA, 22 bp, Artificial Sequence
  Synthetic Construct
gttctgtgggtgcagcagattc

SEQ ID NO: 30854 - DNA, 25 bp, Artificial Sequence
  Synthetic Construct
tgaaaggaaccactgtgagcaaata

SEQ ID NO: 30855 - DNA, 23 bp, Artificial Sequence
  Synthetic Construct
caaaagcagcaccagaggtgata

SEQ ID NO: 30856 - DNA, 22 bp, Artificial Sequence
  Synthetic Construct
gccccaaacttcctctcagtca

SEQ ID NO: 30857 - DNA, 23 bp, Artificial Sequence
  Synthetic Construct
cacctgagcaggatgtattcctt

SEQ ID NO: 30858 - DNA, 24 bp, Artificial Sequence
  Synthetic Construct
gagaacagaatgcgtgtgtgcaat

SEQ ID NO: 30859 - DNA, 24 bp, Artificial Sequence
  Synthetic Construct
ggagaaggtgtgtaggagatgctt

SEQ ID NO: 30860 - DNA, 27 bp, Artificial Sequence
  Synthetic Construct
caaagagactgcattcataccctcatc

SEQ ID NO: 30861 - DNA, 23 bp, Artificial Sequence
  Synthetic Construct
ggaggcctgacgtagaagaagtt

SEQ ID NO: 30862 - DNA, 27 bp, Artificial Sequence
  Synthetic Construct
ctggctctgtcctttttgtgtaaggat

SEQ ID NO: 30863 - DNA, 25 bp, Artificial Sequence
  Synthetic Construct
gtccaaggcagttctacaggatgaa

SEQ ID NO: 30864 - DNA, 24 bp, Artificial Sequence
  Synthetic Construct
cttgttatgcagcgttcaggttca

SEQ ID NO: 30865 - DNA, 25 bp, Artificial Sequence
  Synthetic Construct
acacctccctcaacttagataccaa

SEQ ID NO: 30866 - DNA, 26 bp, Artificial Sequence
  Synthetic Construct
gcaggcagtaggaatggtctatctca

SEQ ID NO: 30867 - DNA, 23 bp, Artificial Sequence
  Synthetic Construct
agagggcctaaaaagcaagaact

SEQ ID NO: 30868 - DNA, 21 bp, Artificial Sequence
  Synthetic Construct
acatctggcccgggaattttt

SEQ ID NO: 30869 - DNA, 25 bp, Artificial Sequence
  Synthetic Construct
aattgcagttcatggaggttgtatg

SEQ ID NO: 30870 - DNA, 22 bp, Artificial Sequence
  Synthetic Construct
ggtgacctacagctgtgttgtt

SEQ ID NO: 30871 - DNA, 23 bp, Artificial Sequence
  Synthetic Construct
ctctgtccctctctacacctgaa

SEQ ID NO: 30872 - DNA, 27 bp, Artificial Sequence
  Synthetic Construct
gatgtcacagtagattacttgggttct

SEQ ID NO: 30873 - DNA, 25 bp, Artificial Sequence
  Synthetic Construct
gttggtaccctcctagacaaagaca

SEQ ID NO: 30874 - DNA, 22 bp, Artificial Sequence
  Synthetic Construct
gtgtgttctcctgttgcagttg

SEQ ID NO: 30875 - DNA, 27 bp, Artificial Sequence
  Synthetic Construct
gctttctaacccaggcactaattcatc

SEQ ID NO: 30876 - DNA, 22 bp, Artificial Sequence
  Synthetic Construct
gccacacgtggaacatggtaac

SEQ ID NO: 30877 - DNA, 22 bp, Artificial Sequence
  Synthetic Construct
gagcagtgactgaaggttctga

SEQ ID NO: 30878 - DNA, 25 bp, Artificial Sequence
  Synthetic Construct
ggagacttaggaagcctacggatag

SEQ ID NO: 30879 - DNA, 28 bp, Artificial Sequence
  Synthetic Construct
cttcttttcttaccggagtatggactct

SEQ ID NO: 30880 - DNA, 23 bp, Artificial Sequence
  Synthetic Construct
gcatgggccacaattcttctttc

SEQ ID NO: 30881 - DNA, 25 bp, Artificial Sequence
  Synthetic Construct
ggacactgtttgtccctctctatct

SEQ ID NO: 30882 - DNA, 22 bp, Artificial Sequence
  Synthetic Construct
gcaagtcatccagcttctgctt

SEQ ID NO: 30883 - DNA, 20 bp, Artificial Sequence
  Synthetic Construct
acctttgccccagcctgaca

SEQ ID NO: 30884 - DNA, 27 bp, Artificial Sequence
  Synthetic Construct
ggctttttggagggtaggtaatcaaag

SEQ ID NO: 30885 - DNA, 22 bp, Artificial Sequence
  Synthetic Construct
gggagttccttggggacaaact

SEQ ID NO: 30886 - DNA, 20 bp, Artificial Sequence
  Synthetic Construct
gcatggggcaaagggtttgt

SEQ ID NO: 30887 - DNA, 20 bp, Artificial Sequence
  Synthetic Construct
tttcagccgctttgggtttg

SEQ ID NO: 30888 - DNA, 23 bp, Artificial Sequence
  Synthetic Construct
gccattgtgtaggcactccgtaa

SEQ ID NO: 30889 - DNA, 22 bp, Artificial Sequence
  Synthetic Construct
gttcagtcctgtgctgggtctt

SEQ ID NO: 30890 - DNA, 20 bp, Artificial Sequence
  Synthetic Construct
acttgctgctctgccctact

SEQ ID NO: 30891 - DNA, 24 bp, Artificial Sequence
  Synthetic Construct
gcatctctgagtcccagtaacctt

SEQ ID NO: 30892 - DNA, 26 bp, Artificial Sequence
  Synthetic Construct
cctgctacaattacctcaatgtctgt

SEQ ID NO: 30893 - DNA, 25 bp, Artificial Sequence
  Synthetic Construct
ggatcagggtagttggactcttttc

SEQ ID NO: 30894 - DNA, 27 bp, Artificial Sequence
  Synthetic Construct
gccctttgtgctataaataagggaatc

SEQ ID NO: 30895 - DNA, 26 bp, Artificial Sequence
  Synthetic Construct
gtgattgcatgaacaccctgatgtat

SEQ ID NO: 30896 - DNA, 24 bp, Artificial Sequence
  Synthetic Construct
ttcaaggatcactgaggactgaag

SEQ ID NO: 30897 - DNA, 23 bp, Artificial Sequence
  Synthetic Construct
gagcatacccaggtcatgtgtca

SEQ ID NO: 30898 - DNA, 24 bp, Artificial Sequence
  Synthetic Construct
gtcaaaaccctagggcagatgttg

SEQ ID NO: 30899 - DNA, 23 bp, Artificial Sequence
  Synthetic Construct
tccagtgccaaagtacaggtaga

SEQ ID NO: 30900 - DNA, 27 bp, Artificial Sequence
  Synthetic Construct
gggattaacatacgtaaggttgcttct

SEQ ID NO: 30901 - DNA, 26 bp, Artificial Sequence
  Synthetic Construct
cctcttctctttcctgctctatcaaa

SEQ ID NO: 30902 - DNA, 25 bp, Artificial Sequence
  Synthetic Construct
caggctgttgggttttggaagattg

SEQ ID NO: 30903 - DNA, 21 bp, Artificial Sequence
  Synthetic Construct
ccgggttccattgggtacaga

SEQ ID NO: 30904 - DNA, 22 bp, Artificial Sequence
  Synthetic Construct
ccgagagcaagaagcaaacatc

SEQ ID NO: 30905 - DNA, 24 bp, Artificial Sequence
  Synthetic Construct
ctgtttccagatggtatggctgtt

SEQ ID NO: 30906 - DNA, 25 bp, Artificial Sequence
  Synthetic Construct
ccctggtaaaaacctgagtcactac

SEQ ID NO: 30907 - DNA, 22 bp, Artificial Sequence
  Synthetic Construct
ggaaccagaaagagggcctatc

SEQ ID NO: 30908 - DNA, 26 bp, Artificial Sequence
  Synthetic Construct
ccaaaccacaaatcaatggggtagta

SEQ ID NO: 30909 - DNA, 28 bp, Artificial Sequence
  Synthetic Construct
ggggtaactttaggaaaaggctgtctac

SEQ ID NO: 30910 - DNA, 27 bp, Artificial Sequence
  Synthetic Construct
cccatcatttagtgattcccagttttg

SEQ ID NO: 30911 - DNA, 25 bp, Artificial Sequence
  Synthetic Construct
gcacagcagtttcgatgatcccaat

SEQ ID NO: 30912 - DNA, 23 bp, Artificial Sequence
  Synthetic Construct
ctggggttttgttctgccagagt

SEQ ID NO: 30913 - DNA, 28 bp, Artificial Sequence
  Synthetic Construct
ccaagttaccttctgctaaagccataca

SEQ ID NO: 30914 - DNA, 24 bp, Artificial Sequence
  Synthetic Construct
tcaaataccacctacccacagatg

SEQ ID NO: 30915 - DNA, 23 bp, Artificial Sequence
  Synthetic Construct
gcattcctggcaagaggaatagt

SEQ ID NO: 30916 - DNA, 21 bp, Artificial Sequence
  Synthetic Construct
tgcccaaggtggggagtctaa

SEQ ID NO: 30917 - DNA, 26 bp, Artificial Sequence
  Synthetic Construct
ctctcctcctcggaaaacatttcgat

SEQ ID NO: 30918 - DNA, 24 bp, Artificial Sequence
  Synthetic Construct
ggaagtctggaaagcaaagcatca

SEQ ID NO: 30919 - DNA, 22 bp, Artificial Sequence
  Synthetic Construct
ggctggctttgtgagtccttgt

SEQ ID NO: 30920 - DNA, 21 bp, Artificial Sequence
  Synthetic Construct
gctgcctgcagtaccaagtct

SEQ ID NO: 30921 - DNA, 30 bp, Artificial Sequence
  Synthetic Construct
gacttggaatctctaacactctcattcaag

SEQ ID NO: 30922 - DNA, 22 bp, Artificial Sequence
  Synthetic Construct
cagtggtggacaagggagaaac

SEQ ID NO: 30923 - DNA, 28 bp, Artificial Sequence
  Synthetic Construct
cctgaagaatatagagccacctaaccta

SEQ ID NO: 30924 - DNA, 24 bp, Artificial Sequence
  Synthetic Construct
tctaaaccccttgtggctagtaga

SEQ ID NO: 30925 - DNA, 21 bp, Artificial Sequence
  Synthetic Construct
atcccacgccctccccatttt

SEQ ID NO: 30926 - DNA, 28 bp, Artificial Sequence
  Synthetic Construct
ggctgtgagttcagtttagatggtttct

SEQ ID NO: 30927 - DNA, 25 bp, Artificial Sequence
  Synthetic Construct
gggatggaatcttgggtgagtgttg

SEQ ID NO: 30928 - DNA, 23 bp, Artificial Sequence
  Synthetic Construct
caccatggagtgttcagagacat

SEQ ID NO: 30929 - DNA, 23 bp, Artificial Sequence
  Synthetic Construct
accccattgaccaaagaatgtgt

SEQ ID NO: 30930 - DNA, 24 bp, Artificial Sequence
  Synthetic Construct
gcacacatcccttgttttgcacat

SEQ ID NO: 30931 - DNA, 21 bp, Artificial Sequence
  Synthetic Construct
cctctctggctcccatgttct

SEQ ID NO: 30932 - DNA, 24 bp, Artificial Sequence
  Synthetic Construct
ctgagatgccgtcttggtctaaaa

SEQ ID NO: 30933 - DNA, 25 bp, Artificial Sequence
  Synthetic Construct
agtcagggctactcatacagaaaag

SEQ ID NO: 30934 - DNA, 27 bp, Artificial Sequence
  Synthetic Construct
gtgtagtaacccagcatcagagttctt

SEQ ID NO: 30935 - DNA, 21 bp, Artificial Sequence
  Synthetic Construct
ccttcaaaggtcaccgcctaa

SEQ ID NO: 30936 - DNA, 30 bp, Artificial Sequence
  Synthetic Construct
ccaactagatatggccatgtaactccattc

SEQ ID NO: 30937 - DNA, 26 bp, Artificial Sequence
  Synthetic Construct
ctggtgagtctaatcacttgggacat

SEQ ID NO: 30938 - DNA, 26 bp, Artificial Sequence
  Synthetic Construct
tgagttatcagcctgagtctacttga

SEQ ID NO: 30939 - DNA, 21 bp, Artificial Sequence
  Synthetic Construct
ctttcaggctgcactggatgt

SEQ ID NO: 30940 - DNA, 24 bp, Artificial Sequence
  Synthetic Construct
cagctttcgcgaagtactaggtat

SEQ ID NO: 30941 - DNA, 25 bp, Artificial Sequence
  Synthetic Construct
ggtctgtctttcagctctgatcaat

SEQ ID NO: 30942 - DNA, 26 bp, Artificial Sequence
  Synthetic Construct
gaccgatccattaagaagatgctgta

SEQ ID NO: 30943 - DNA, 25 bp, Artificial Sequence
  Synthetic Construct
ctccttggaaggcatttctgagtgt

SEQ ID NO: 30944 - DNA, 20 bp, Artificial Sequence
  Synthetic Construct
cccctccagccagagacaga

SEQ ID NO: 30945 - DNA, 22 bp, Artificial Sequence
  Synthetic Construct
tgacctgtgtggaggcatctct

SEQ ID NO: 30946 - DNA, 27 bp, Artificial Sequence
  Synthetic Construct
gcagtgagggttggtaaatagtgttca

SEQ ID NO: 30947 - DNA, 21 bp, Artificial Sequence
  Synthetic Construct
ggagggtgtggcaaactgtgt

SEQ ID NO: 30948 - DNA, 29 bp, Artificial Sequence
  Synthetic Construct
cctgagaatgcttttgtggaactttcgtt

SEQ ID NO: 30949 - DNA, 22 bp, Artificial Sequence
  Synthetic Construct
gtttcagccaggagatgagctt

SEQ ID NO: 30950 - DNA, 23 bp, Artificial Sequence
  Synthetic Construct
gggttcagtcacgttgcttgctt

SEQ ID NO: 30951 - DNA, 21 bp, Artificial Sequence
  Synthetic Construct
ccaaccggtaaccaccacttc

SEQ ID NO: 30952 - DNA, 24 bp, Artificial Sequence
  Synthetic Construct
gggtaagccttctgagggagcatt

SEQ ID NO: 30953 - DNA, 23 bp, Artificial Sequence
  Synthetic Construct
ggaagggtggtttcttgggacaa

SEQ ID NO: 30954 - DNA, 23 bp, Artificial Sequence
  Synthetic Construct
agatgatccattcctccccttca

SEQ ID NO: 30955 - DNA, 26 bp, Artificial Sequence
  Synthetic Construct
ggaacttacagtggttggaataggtt

SEQ ID NO: 30956 - DNA, 22 bp, Artificial Sequence
  Synthetic Construct
ggccaggcaataagctttcctt

SEQ ID NO: 30957 - DNA, 30 bp, Artificial Sequence
  Synthetic Construct
gagagtctctactcttagctcttagtggtt

SEQ ID NO: 30958 - DNA, 26 bp, Artificial Sequence
  Synthetic Construct
ccaatggagaatttcaaagccctaga

SEQ ID NO: 30959 - DNA, 25 bp, Artificial Sequence
  Synthetic Construct
gccaaccacaagttttgtagcagtt

SEQ ID NO: 30960 - DNA, 24 bp, Artificial Sequence
  Synthetic Construct
ggactgcctggtattctctttctt

SEQ ID NO: 30961 - DNA, 23 bp, Artificial Sequence
  Synthetic Construct
tggtgaaaaggacttggaacctt

SEQ ID NO: 30962 - DNA, 24 bp, Artificial Sequence
  Synthetic Construct
cattatgtgccaacacccttctac

SEQ ID NO: 30963 - DNA, 26 bp, Artificial Sequence
  Synthetic Construct
gtaagactaccttgctctgttcaagt

SEQ ID NO: 30964 - DNA, 25 bp, Artificial Sequence
  Synthetic Construct
ttgacttcaccaaaacatcctgttc

SEQ ID NO: 30965 - DNA, 22 bp, Artificial Sequence
  Synthetic Construct
ctcctggcagacaagcaacaag

SEQ ID NO: 30966 - DNA, 27 bp, Artificial Sequence
  Synthetic Construct
ggtataagattcatcatctgggctgaa

SEQ ID NO: 30967 - DNA, 21 bp, Artificial Sequence
  Synthetic Construct
cagcaagtgcactctttgcat

SEQ ID NO: 30968 - DNA, 30 bp, Artificial Sequence
  Synthetic Construct
cgatgcctaagatacagctgatactcaatg

SEQ ID NO: 30969 - DNA, 27 bp, Artificial Sequence
  Synthetic Construct
cagagaaccttcctaaattccctttct

SEQ ID NO: 30970 - DNA, 27 bp, Artificial Sequence
  Synthetic Construct
gctttgtaacagggttatacaggtttc

SEQ ID NO: 30971 - DNA, 26 bp, Artificial Sequence
  Synthetic Construct
ccaaacttaagggaccctacgaccta

SEQ ID NO: 30972 - DNA, 23 bp, Artificial Sequence
  Synthetic Construct
cccaccatgaattgctgttgctt

SEQ ID NO: 30973 - DNA, 24 bp, Artificial Sequence
  Synthetic Construct
gggtgcaggacactgtgtatggta

SEQ ID NO: 30974 - DNA, 24 bp, Artificial Sequence
  Synthetic Construct
cacagaggtgaaaagggactgaag

SEQ ID NO: 30975 - DNA, 27 bp, Artificial Sequence
  Synthetic Construct
gttcaagactgtttacttggccttatg

SEQ ID NO: 30976 - DNA, 22 bp, Artificial Sequence
  Synthetic Construct
gaaggctggaacaagtccagaa

SEQ ID NO: 30977 - DNA, 26 bp, Artificial Sequence
  Synthetic Construct
cccttctgaggactaaacccaggaaa

SEQ ID NO: 30978 - DNA, 23 bp, Artificial Sequence
  Synthetic Construct
ccctcagccaattcttggtcaat

SEQ ID NO: 30979 - DNA, 21 bp, Artificial Sequence
  Synthetic Construct
cggaatgctggcattggaaag

SEQ ID NO: 30980 - DNA, 22 bp, Artificial Sequence
  Synthetic Construct
gcccagtgcaagcttcagtttc

SEQ ID NO: 30981 - DNA, 28 bp, Artificial Sequence
  Synthetic Construct
gctcagttatagggtgattcacttcaga

SEQ ID NO: 30982 - DNA, 26 bp, Artificial Sequence
  Synthetic Construct
cccacttccctgaagactgaatccta

SEQ ID NO: 30983 - DNA, 21 bp, Artificial Sequence
  Synthetic Construct
ccctgcagtggtcctgacttc

SEQ ID NO: 30984 - DNA, 26 bp, Artificial Sequence
  Synthetic Construct
ggagtaacttgaaactggacatgaca

SEQ ID NO: 30985 - DNA, 25 bp, Artificial Sequence
  Synthetic Construct
cctgtaagccaaagaaaggggttga

SEQ ID NO: 30986 - DNA, 21 bp, Artificial Sequence
  Synthetic Construct
aagtcattcgggctgttctgt

SEQ ID NO: 30987 - DNA, 24 bp, Artificial Sequence
  Synthetic Construct
gactgcctagttgcctgtatcatc

SEQ ID NO: 30988 - DNA, 24 bp, Artificial Sequence
  Synthetic Construct
ccctcctgcccattttaacagcaa

SEQ ID NO: 30989 - DNA, 20 bp, Artificial Sequence
  Synthetic Construct
ggtcaagcgggaagggcttt

SEQ ID NO: 30990 - DNA, 23 bp, Artificial Sequence
  Synthetic Construct
accccatggcacctatttgtttc

SEQ ID NO: 30991 - DNA, 28 bp, Artificial Sequence
  Synthetic Construct
ggcctacaaattagtacagtccctctca

SEQ ID NO: 30992 - DNA, 24 bp, Artificial Sequence
  Synthetic Construct
gccagcatcacagagatagggaaa

SEQ ID NO: 30993 - DNA, 21 bp, Artificial Sequence
  Synthetic Construct
aaggccctgacatggctggaa

SEQ ID NO: 30994 - DNA, 26 bp, Artificial Sequence
  Synthetic Construct
ggtcattggtgaccttcatgttgcta

SEQ ID NO: 30995 - DNA, 25 bp, Artificial Sequence
  Synthetic Construct
ggagataagcccctttccttaagtt

SEQ ID NO: 30996 - DNA, 24 bp, Artificial Sequence
  Synthetic Construct
cctcccgtccccatattcctttca

SEQ ID NO: 30997 - DNA, 27 bp, Artificial Sequence
  Synthetic Construct
gttggacaccttatgctcattcaagat

SEQ ID NO: 30998 - DNA, 22 bp, Artificial Sequence
  Synthetic Construct
ggtgatgtctgagctggacctt

SEQ ID NO: 30999 - DNA, 27 bp, Artificial Sequence
  Synthetic Construct
gagtgctttagtgaatcccaacagtga

SEQ ID NO: 31000 - DNA, 22 bp, Artificial Sequence
  Synthetic Construct
ggccgggatggcttacattgat

SEQ ID NO: 31001 - DNA, 25 bp, Artificial Sequence
  Synthetic Construct
ttttgtctgtgaaggaggcatttac

SEQ ID NO: 31002 - DNA, 25 bp, Artificial Sequence
  Synthetic Construct
cccaataaatcccactgtcttgtct

SEQ ID NO: 31003 - DNA, 22 bp, Artificial Sequence
  Synthetic Construct
gcttgctggacattgcagtcat

SEQ ID NO: 31004 - DNA, 22 bp, Artificial Sequence
  Synthetic Construct
gagctggagtccctgctttgtt

SEQ ID NO: 31005 - DNA, 24 bp, Artificial Sequence
  Synthetic Construct
gcaaaaatctgcggccttttcgta

SEQ ID NO: 31006 - DNA, 27 bp, Artificial Sequence
  Synthetic Construct
gtatacagagtgaagctgtagaagtca

SEQ ID NO: 31007 - DNA, 29 bp, Artificial Sequence
  Synthetic Construct
ggacaagaagtaaatgggagtgaaaggta

SEQ ID NO: 31008 - DNA, 23 bp, Artificial Sequence
  Synthetic Construct
cctaggagaccagctgtggtttg

SEQ ID NO: 31009 - DNA, 24 bp, Artificial Sequence
  Synthetic Construct
agactatggaacctactggtgaca

SEQ ID NO: 31010 - DNA, 20 bp, Artificial Sequence
  Synthetic Construct
accgtgcatccagagtgatg

SEQ ID NO: 31011 - DNA, 22 bp, Artificial Sequence
  Synthetic Construct
cacggggctgtttctccatctt

SEQ ID NO: 31012 - DNA, 22 bp, Artificial Sequence
  Synthetic Construct
cttcatcctcggcctcttttct

SEQ ID NO: 31013 - DNA, 22 bp, Artificial Sequence
  Synthetic Construct
ggcacagaggcagcctgataat

SEQ ID NO: 31014 - DNA, 25 bp, Artificial Sequence
  Synthetic Construct
ggtgaaaagtgtgaaggactcatct

SEQ ID NO: 31015 - DNA, 25 bp, Artificial Sequence
  Synthetic Construct
caggagagctgactcaacttcagat

SEQ ID NO: 31016 - DNA, 24 bp, Artificial Sequence
  Synthetic Construct
gcactccaaacaggtcttcagaaa

SEQ ID NO: 31017 - DNA, 27 bp, Artificial Sequence
  Synthetic Construct
gctactgcacaattggacttgttcttg

SEQ ID NO: 31018 - DNA, 27 bp, Artificial Sequence
  Synthetic Construct
gctgtgtttaggtgactagggatcaga

SEQ ID NO: 31019 - DNA, 22 bp, Artificial Sequence
  Synthetic Construct
tgccgacagcttcaagggtaga

SEQ ID NO: 31020 - DNA, 23 bp, Artificial Sequence
  Synthetic Construct
ctcccactttttccaccttcaga

SEQ ID NO: 31021 - DNA, 22 bp, Artificial Sequence
  Synthetic Construct
tgagtctgtctccccgacatct

SEQ ID NO: 31022 - DNA, 18 bp, Artificial Sequence
  Synthetic Construct
tttgcgccctgactgcat

SEQ ID NO: 31023 - DNA, 20 bp, Artificial Sequence
  Synthetic Construct
agccaacacgcagggacaat

SEQ ID NO: 31024 - DNA, 23 bp, Artificial Sequence
  Synthetic Construct
cacaggtcctgcagattttctct

SEQ ID NO: 31025 - DNA, 30 bp, Artificial Sequence
  Synthetic Construct
ggagccaaatgagagtcaattttcctttct

SEQ ID NO: 31026 - DNA, 25 bp, Artificial Sequence
  Synthetic Construct
cctctgcaggctattcgtgtatttc

SEQ ID NO: 31027 - DNA, 22 bp, Artificial Sequence
  Synthetic Construct
ccagtgggtgcaaacaaacaca

SEQ ID NO: 31028 - DNA, 21 bp, Artificial Sequence
  Synthetic Construct
ttggctcctttcccctagaca

SEQ ID NO: 31029 - DNA, 21 bp, Artificial Sequence
  Synthetic Construct
gcacacgtggccacaaagaaa

SEQ ID NO: 31030 - DNA, 22 bp, Artificial Sequence
  Synthetic Construct
tgaagacgggtggggtccttta

SEQ ID NO: 31031 - DNA, 25 bp, Artificial Sequence
  Synthetic Construct
ggcaggatgaagtatggacctgaga

SEQ ID NO: 31032 - DNA, 25 bp, Artificial Sequence
  Synthetic Construct
cacctacctcactaagacccaagat

SEQ ID NO: 31033 - DNA, 21 bp, Artificial Sequence
  Synthetic Construct
ccccaagctgctctctgtaag

SEQ ID NO: 31034 - DNA, 27 bp, Artificial Sequence
  Synthetic Construct
acttaatgaagaagggtctaccgagat

SEQ ID NO: 31035 - DNA, 26 bp, Artificial Sequence
  Synthetic Construct
cagggcttcaactgaaggactctaag

SEQ ID NO: 31036 - DNA, 20 bp, Artificial Sequence
  Synthetic Construct
cccactcatccaccctgact

SEQ ID NO: 31037 - DNA, 26 bp, Artificial Sequence
  Synthetic Construct
gaagtgtcaacttctcagcaagtaag

SEQ ID NO: 31038 - DNA, 25 bp, Artificial Sequence
  Synthetic Construct
gcctcgtagtatagcttggaaagta

SEQ ID NO: 31039 - DNA, 22 bp, Artificial Sequence
  Synthetic Construct
cgttgaggagcacctgtatcaa

SEQ ID NO: 31040 - DNA, 18 bp, Artificial Sequence
  Synthetic Construct
tgggcagcccctaactgt

SEQ ID NO: 31041 - DNA, 23 bp, Artificial Sequence
  Synthetic Construct
ttgtggaacggaggaagagtatg

SEQ ID NO: 31042 - DNA, 24 bp, Artificial Sequence
  Synthetic Construct
gctgctgggtcagtcttgaacatt

SEQ ID NO: 31043 - DNA, 24 bp, Artificial Sequence
  Synthetic Construct
ccctctgttcctatggtcctggtt

SEQ ID NO: 31044 - DNA, 24 bp, Artificial Sequence
  Synthetic Construct
cctgcccagccttttatgggtaga

SEQ ID NO: 31045 - DNA, 25 bp, Artificial Sequence
  Synthetic Construct
aggaggtcttttcaaacccttttca

SEQ ID NO: 31046 - DNA, 26 bp, Artificial Sequence
  Synthetic Construct
caatgacgaggcaagtcaatatctct

SEQ ID NO: 31047 - DNA, 22 bp, Artificial Sequence
  Synthetic Construct
ttccctgtccctgtcactcctt

SEQ ID NO: 31048 - DNA, 30 bp, Artificial Sequence
  Synthetic Construct
gctgatcaaagagggatattctatggcatt

SEQ ID NO: 31049 - DNA, 20 bp, Artificial Sequence
  Synthetic Construct
gcacatggctccctttctga

SEQ ID NO: 31050 - DNA, 24 bp, Artificial Sequence
  Synthetic Construct
ctggaagaaggaaccctggatatg

SEQ ID NO: 31051 - DNA, 25 bp, Artificial Sequence
  Synthetic Construct
cagagtacttcttcctgaccctaac

SEQ ID NO: 31052 - DNA, 24 bp, Artificial Sequence
  Synthetic Construct
tgaattacacagcttcaggccttt

SEQ ID NO: 31053 - DNA, 25 bp, Artificial Sequence
  Synthetic Construct
tgcttgccttttgcagtaaatgtag

SEQ ID NO: 31054 - DNA, 26 bp, Artificial Sequence
  Synthetic Construct
ggaaacctcaatgtgaactgctctct

SEQ ID NO: 31055 - DNA, 21 bp, Artificial Sequence
  Synthetic Construct
cgagtcagccacttgtgaaac

SEQ ID NO: 31056 - DNA, 26 bp, Artificial Sequence
  Synthetic Construct
cactgtatctggcctggatccaattt

SEQ ID NO: 31057 - DNA, 23 bp, Artificial Sequence
  Synthetic Construct
ggcacaaagctagacttccagta

SEQ ID NO: 31058 - DNA, 23 bp, Artificial Sequence
  Synthetic Construct
gcaaaggtggtttcaaagtcaca

SEQ ID NO: 31059 - DNA, 24 bp, Artificial Sequence
  Synthetic Construct
ggaaacattccctgccatctccta

SEQ ID NO: 31060 - DNA, 22 bp, Artificial Sequence
  Synthetic Construct
agtgcaggcttaaggaaaggtt

SEQ ID NO: 31061 - DNA, 25 bp, Artificial Sequence
  Synthetic Construct
gtggtgaacatagtccccagtaaat

SEQ ID NO: 31062 - DNA, 30 bp, Artificial Sequence
  Synthetic Construct
ggagggaagaggctagattaaataccttag

SEQ ID NO: 31063 - DNA, 24 bp, Artificial Sequence
  Synthetic Construct
gctgacattgaagaccaaggaatc

SEQ ID NO: 31064 - DNA, 23 bp, Artificial Sequence
  Synthetic Construct
cagtgagcgcaaccattccaatc

SEQ ID NO: 31065 - DNA, 28 bp, Artificial Sequence
  Synthetic Construct
ccagatcacatagggcattttagaccat

SEQ ID NO: 31066 - DNA, 24 bp, Artificial Sequence
  Synthetic Construct
acttattcactgtggccacctttc

SEQ ID NO: 31067 - DNA, 26 bp, Artificial Sequence
  Synthetic Construct
ctcgatcaaatgcagtggtcaaatgt

SEQ ID NO: 31068 - DNA, 25 bp, Artificial Sequence
  Synthetic Construct
ctcagccttttatcctgttctgtgt

SEQ ID NO: 31069 - DNA, 23 bp, Artificial Sequence
  Synthetic Construct
cccaccccaccttctcctttttg

SEQ ID NO: 31070 - DNA, 24 bp, Artificial Sequence
  Synthetic Construct
ggtccttgagttcggggttaggat

SEQ ID NO: 31071 - DNA, 24 bp, Artificial Sequence
  Synthetic Construct
gtcatcctgaaagtctccgctaca

SEQ ID NO: 31072 - DNA, 20 bp, Artificial Sequence
  Synthetic Construct
actgcctctttggccacgta

SEQ ID NO: 31073 - DNA, 25 bp, Artificial Sequence
  Synthetic Construct
gaaccactgccttagatcaaacaaa

SEQ ID NO: 31074 - DNA, 22 bp, Artificial Sequence
  Synthetic Construct
ccacagcacctatgccaagtga

SEQ ID NO: 31075 - DNA, 20 bp, Artificial Sequence
  Synthetic Construct
ggacagcccaggtgagtcat

SEQ ID NO: 31076 - DNA, 24 bp, Artificial Sequence
  Synthetic Construct
ggcctagtctccctaagcctaatg

SEQ ID NO: 31077 - DNA, 26 bp, Artificial Sequence
  Synthetic Construct
cccaggagtagcccttaaccaattac

SEQ ID NO: 31078 - DNA, 25 bp, Artificial Sequence
  Synthetic Construct
ccagaattggaattgggttccagta

SEQ ID NO: 31079 - DNA, 21 bp, Artificial Sequence
  Synthetic Construct
caaccaggcttgggagaaaca

SEQ ID NO: 31080 - DNA, 25 bp, Artificial Sequence
  Synthetic Construct
catggttgattgtcggttgttcttc

SEQ ID NO: 31081 - DNA, 23 bp, Artificial Sequence
  Synthetic Construct
gccttttatccctgagccattga

SEQ ID NO: 31082 - DNA, 24 bp, Artificial Sequence
  Synthetic Construct
gcctcatcctcctttcagacaatg

SEQ ID NO: 31083 - DNA, 29 bp, Artificial Sequence
  Synthetic Construct
ggactaaagtaaaagaggcagtgagatga

SEQ ID NO: 31084 - DNA, 23 bp, Artificial Sequence
  Synthetic Construct
cagcgtcatggtccagaatcctt

SEQ ID NO: 31085 - DNA, 20 bp, Artificial Sequence
  Synthetic Construct
gacgcccactgtgattggtt

SEQ ID NO: 31086 - DNA, 20 bp, Artificial Sequence
  Synthetic Construct
agacaaggtcggctgcaaca

SEQ ID NO: 31087 - DNA, 25 bp, Artificial Sequence
  Synthetic Construct
ccagcataaggagcctgtgattttg

SEQ ID NO: 31088 - DNA, 20 bp, Artificial Sequence
  Synthetic Construct
atctcagtcccaggccaact

SEQ ID NO: 31089 - DNA, 22 bp, Artificial Sequence
  Synthetic Construct
ccttcccagtccaactccaaag

SEQ ID NO: 31090 - DNA, 23 bp, Artificial Sequence
  Synthetic Construct
ggttctgtgaatgccagcgctaa

SEQ ID NO: 31091 - DNA, 22 bp, Artificial Sequence
  Synthetic Construct
ctgggccctgtaacagtgagaa

SEQ ID NO: 31092 - DNA, 29 bp, Artificial Sequence
  Synthetic Construct
ccatccataaagtgtataccctcccttgt

SEQ ID NO: 31093 - DNA, 21 bp, Artificial Sequence
  Synthetic Construct
aggcatagtggtccccgtgta

SEQ ID NO: 31094 - DNA, 20 bp, Artificial Sequence
  Synthetic Construct
tcactcacctgggccctaaa

SEQ ID NO: 31095 - DNA, 26 bp, Artificial Sequence
  Synthetic Construct
ggcttgccatattactgagtgcaaaa

SEQ ID NO: 31096 - DNA, 24 bp, Artificial Sequence
  Synthetic Construct
tcaggatggcactggaacttaatc

SEQ ID NO: 31097 - DNA, 25 bp, Artificial Sequence
  Synthetic Construct
ggataataaggcgtatggcaacaaa

SEQ ID NO: 31098 - DNA, 24 bp, Artificial Sequence
  Synthetic Construct
gggagagacagactccagcaatca

SEQ ID NO: 31099 - DNA, 24 bp, Artificial Sequence
  Synthetic Construct
cagtgtcttcatccctcacggaat

SEQ ID NO: 31100 - DNA, 23 bp, Artificial Sequence
  Synthetic Construct
accctctggatgggtaaggtaac

SEQ ID NO: 31101 - DNA, 23 bp, Artificial Sequence
  Synthetic Construct
gtccctctgggacagaacatact

SEQ ID NO: 31102 - DNA, 24 bp, Artificial Sequence
  Synthetic Construct
cccctgaacattgctgatcctctt

SEQ ID NO: 31103 - DNA, 24 bp, Artificial Sequence
  Synthetic Construct
ctgcagctgtttctttcccatagt

SEQ ID NO: 31104 - DNA, 23 bp, Artificial Sequence
  Synthetic Construct
tcaggctcagagtggagaataca

SEQ ID NO: 31105 - DNA, 24 bp, Artificial Sequence
  Synthetic Construct
gcttcaattcctttctggggaagt

SEQ ID NO: 31106 - DNA, 25 bp, Artificial Sequence
  Synthetic Construct
tcctcctcctgtctttttaggctat

SEQ ID NO: 31107 - DNA, 22 bp, Artificial Sequence
  Synthetic Construct
gcccctacccagaccagaaaaa

SEQ ID NO: 31108 - DNA, 29 bp, Artificial Sequence
  Synthetic Construct
gagactaacaggtaagatccaggattcaa

SEQ ID NO: 31109 - DNA, 21 bp, Artificial Sequence
  Synthetic Construct
aggcaggcctcacaatgtatc

SEQ ID NO: 31110 - DNA, 25 bp, Artificial Sequence
  Synthetic Construct
gcaaaggaaatgaatggcatcagta

SEQ ID NO: 31111 - DNA, 24 bp, Artificial Sequence
  Synthetic Construct
gcaagagagagacttggtctgcat

SEQ ID NO: 31112 - DNA, 29 bp, Artificial Sequence
  Synthetic Construct
ggctgtagctgccatttataactactttc

SEQ ID NO: 31113 - DNA, 25 bp, Artificial Sequence
  Synthetic Construct
cagagagcaagtaagctgtcccttt

SEQ ID NO: 31114 - DNA, 24 bp, Artificial Sequence
  Synthetic Construct
gcttgggttacatgcttcctggta

SEQ ID NO: 31115 - DNA, 22 bp, Artificial Sequence
  Synthetic Construct
atcgggagtatcagggatggaa

SEQ ID NO: 31116 - DNA, 26 bp, Artificial Sequence
  Synthetic Construct
ggattttaagtaggggagcaatgtga

SEQ ID NO: 31117 - DNA, 27 bp, Artificial Sequence
  Synthetic Construct
ggagatactcagcctttggacatgaag

SEQ ID NO: 31118 - DNA, 23 bp, Artificial Sequence
  Synthetic Construct
gccctggggagatagatgtgcta

SEQ ID NO: 31119 - DNA, 27 bp, Artificial Sequence
  Synthetic Construct
gacttttcccctaccacctataatcaa

SEQ ID NO: 31120 - DNA, 20 bp, Artificial Sequence
  Synthetic Construct
tgtccaaggtcgcgcagata

SEQ ID NO: 31121 - DNA, 22 bp, Artificial Sequence
  Synthetic Construct
ggctagccagcaaggattctga

SEQ ID NO: 31122 - DNA, 26 bp, Artificial Sequence
  Synthetic Construct
ctcatgtaccagtactaagccattct

SEQ ID NO: 31123 - DNA, 20 bp, Artificial Sequence
  Synthetic Construct
ttcccaggtggccatgtagt

SEQ ID NO: 31124 - DNA, 22 bp, Artificial Sequence
  Synthetic Construct
cgccaaggcctgttccaaaaac

SEQ ID NO: 31125 - DNA, 22 bp, Artificial Sequence
  Synthetic Construct
tggctgaaagcaggtcgctatg

SEQ ID NO: 31126 - DNA, 22 bp, Artificial Sequence
  Synthetic Construct
gacaggcagaggagttctgtga

SEQ ID NO: 31127 - DNA, 22 bp, Artificial Sequence
  Synthetic Construct
cctgtgggttgcttctgtctct

SEQ ID NO: 31128 - DNA, 21 bp, Artificial Sequence
  Synthetic Construct
agagccctatccccactgaac

SEQ ID NO: 31129 - DNA, 24 bp, Artificial Sequence
  Synthetic Construct
catctgtggccaggtaaggaatag

SEQ ID NO: 31130 - DNA, 26 bp, Artificial Sequence
  Synthetic Construct
gtgaatcttcaacagcagatgagtct

SEQ ID NO: 31131 - DNA, 21 bp, Artificial Sequence
  Synthetic Construct
gggctgaacagtggtctgaca

SEQ ID NO: 31132 - DNA, 19 bp, Artificial Sequence
  Synthetic Construct
atcgccctctcccctgcat

SEQ ID NO: 31133 - DNA, 25 bp, Artificial Sequence
  Synthetic Construct
gtgagaaatatggagacagccagtt

SEQ ID NO: 31134 - DNA, 26 bp, Artificial Sequence
  Synthetic Construct
caggaactgtctgaagaagctaaaag

SEQ ID NO: 31135 - DNA, 23 bp, Artificial Sequence
  Synthetic Construct
gctgaaaggctcactgctaggta

SEQ ID NO: 31136 - DNA, 24 bp, Artificial Sequence
  Synthetic Construct
cccacagagtatggtgatgactgt

SEQ ID NO: 31137 - DNA, 25 bp, Artificial Sequence
  Synthetic Construct
cactccatcttcctaatggcctact

SEQ ID NO: 31138 - DNA, 26 bp, Artificial Sequence
  Synthetic Construct
ggatccaaggactgtattccaactga

SEQ ID NO: 31139 - DNA, 25 bp, Artificial Sequence
  Synthetic Construct
ggagttagccctttagacgtcttgt

SEQ ID NO: 31140 - DNA, 21 bp, Artificial Sequence
  Synthetic Construct
ggtgtgctgcaggggtatgtt

SEQ ID NO: 31141 - DNA, 25 bp, Artificial Sequence
  Synthetic Construct
atgtgaggaaatcatcccatcttgt

SEQ ID NO: 31142 - DNA, 20 bp, Artificial Sequence
  Synthetic Construct
aaggcaggtgcagggatgaa

SEQ ID NO: 31143 - DNA, 24 bp, Artificial Sequence
  Synthetic Construct
ccttatgtgacatccaggactcaa

SEQ ID NO: 31144 - DNA, 25 bp, Artificial Sequence
  Synthetic Construct
aggttgagcaagactacacctaatg

SEQ ID NO: 31145 - DNA, 19 bp, Artificial Sequence
  Synthetic Construct
ccccacctgcgcttcactt

SEQ ID NO: 31146 - DNA, 22 bp, Artificial Sequence
  Synthetic Construct
tgtaccaaagctggggcagtag

SEQ ID NO: 31147 - DNA, 22 bp, Artificial Sequence
  Synthetic Construct
ctcggcgagtgacggataaaca

SEQ ID NO: 31148 - DNA, 24 bp, Artificial Sequence
  Synthetic Construct
cctcttcccttcatccctctctgt

SEQ ID NO: 31149 - DNA, 21 bp, Artificial Sequence
  Synthetic Construct
taggcccatgtcccgcttact

SEQ ID NO: 31150 - DNA, 21 bp, Artificial Sequence
  Synthetic Construct
gacgtcagaagaggcatggtt

SEQ ID NO: 31151 - DNA, 22 bp, Artificial Sequence
  Synthetic Construct
gccacagctcagacgagcttat

SEQ ID NO: 31152 - DNA, 19 bp, Artificial Sequence
  Synthetic Construct
tgggtggcatcaggacctt

SEQ ID NO: 31153 - DNA, 23 bp, Artificial Sequence
  Synthetic Construct
gggtattcagtggtacccgatgt

SEQ ID NO: 31154 - DNA, 27 bp, Artificial Sequence
  Synthetic Construct
ccaaaagcatttgagaagaagcagtga

SEQ ID NO: 31155 - DNA, 25 bp, Artificial Sequence
  Synthetic Construct
gtgttttgaaaggctaactctggtt

SEQ ID NO: 31156 - DNA, 23 bp, Artificial Sequence
  Synthetic Construct
gcccttgttggggactttgtgta

SEQ ID NO: 31157 - DNA, 22 bp, Artificial Sequence
  Synthetic Construct
ttagggcctggaatggggtttc

SEQ ID NO: 31158 - DNA, 22 bp, Artificial Sequence
  Synthetic Construct
ggcttgaaccacttggctctct

SEQ ID NO: 31159 - DNA, 24 bp, Artificial Sequence
  Synthetic Construct
gggatcctgggacttcctgtaatc

SEQ ID NO: 31160 - DNA, 28 bp, Artificial Sequence
  Synthetic Construct
cctcttgaaggtccccaaatattcttga

SEQ ID NO: 31161 - DNA, 30 bp, Artificial Sequence
  Synthetic Construct
gggcatatgagattataagggctagttttg

SEQ ID NO: 31162 - DNA, 24 bp, Artificial Sequence
  Synthetic Construct
tgctctgctgatactgtacttgtt

SEQ ID NO: 31163 - DNA, 29 bp, Artificial Sequence
  Synthetic Construct
gaggggaaatggagataaagtgttctaag

SEQ ID NO: 31164 - DNA, 23 bp, Artificial Sequence
  Synthetic Construct
ccaatcctccctcttgcagtttc

SEQ ID NO: 31165 - DNA, 22 bp, Artificial Sequence
  Synthetic Construct
gtgaggcatttccccaccactt

SEQ ID NO: 31166 - DNA, 22 bp, Artificial Sequence
  Synthetic Construct
tgaaccacagcaaggcagatac

SEQ ID NO: 31167 - DNA, 19 bp, Artificial Sequence
  Synthetic Construct
tgagccctgcagacaccaa

SEQ ID NO: 31168 - DNA, 26 bp, Artificial Sequence
  Synthetic Construct
gccttcttagttcctagtagctgatt

SEQ ID NO: 31169 - DNA, 22 bp, Artificial Sequence
  Synthetic Construct
gctgctgccctgattctagctt

SEQ ID NO: 31170 - DNA, 24 bp, Artificial Sequence
  Synthetic Construct
cttccaagtgctgccatttagtca

SEQ ID NO: 31171 - DNA, 25 bp, Artificial Sequence
  Synthetic Construct
ctctacaataagtgcatccccagaa

SEQ ID NO: 31172 - DNA, 20 bp, Artificial Sequence
  Synthetic Construct
cctgctggacaagcttcctt

SEQ ID NO: 31173 - DNA, 21 bp, Artificial Sequence
  Synthetic Construct
acccctcctccactggtttca

SEQ ID NO: 31174 - DNA, 26 bp, Artificial Sequence
  Synthetic Construct
ccccattgatgccaagagatcctaag

SEQ ID NO: 31175 - DNA, 24 bp, Artificial Sequence
  Synthetic Construct
gctgagcatgaagtcaggagaaac

SEQ ID NO: 31176 - DNA, 28 bp, Artificial Sequence
  Synthetic Construct
gagaggaagaaactgacaggtactcaag

SEQ ID NO: 31177 - DNA, 24 bp, Artificial Sequence
  Synthetic Construct
ctgctcagaatttgcctcaagttt

SEQ ID NO: 31178 - DNA, 26 bp, Artificial Sequence
  Synthetic Construct
gagagaaccctaggactccacatttc

SEQ ID NO: 31179 - DNA, 22 bp, Artificial Sequence
  Synthetic Construct
gctgaagcatagtggtccagat

SEQ ID NO: 31180 - DNA, 26 bp, Artificial Sequence
  Synthetic Construct
ccacaaagtttttgacactcctctct

SEQ ID NO: 31181 - DNA, 24 bp, Artificial Sequence
  Synthetic Construct
cacacaaggcagtgtgttgtccta

SEQ ID NO: 31182 - DNA, 20 bp, Artificial Sequence
  Synthetic Construct
atgggcacagaagccacttt

SEQ ID NO: 31183 - DNA, 29 bp, Artificial Sequence
  Synthetic Construct
gtcaagctataaactacagacccatctct

SEQ ID NO: 31184 - DNA, 25 bp, Artificial Sequence
  Synthetic Construct
ctcatggagttgaaggcttggtttg

SEQ ID NO: 31185 - DNA, 25 bp, Artificial Sequence
  Synthetic Construct
gaagtttgaaaggccactaggtgtt

SEQ ID NO: 31186 - DNA, 26 bp, Artificial Sequence
  Synthetic Construct
ggcctcaatatggaacctacattgtt

SEQ ID NO: 31187 - DNA, 23 bp, Artificial Sequence
  Synthetic Construct
cgagggaggtaatgggagctaga

SEQ ID NO: 31188 - DNA, 20 bp, Artificial Sequence
  Synthetic Construct
tgcatcccaacagggctttc

SEQ ID NO: 31189 - DNA, 21 bp, Artificial Sequence
  Synthetic Construct
tgtccacggtatccacactga

SEQ ID NO: 31190 - DNA, 21 bp, Artificial Sequence
  Synthetic Construct
ggttccaagggcaccacattt

SEQ ID NO: 31191 - DNA, 28 bp, Artificial Sequence
  Synthetic Construct
ctgatacaccagtgtccctaatttccaa

SEQ ID NO: 31192 - DNA, 27 bp, Artificial Sequence
  Synthetic Construct
ctgatctttaaggcccaatactgtaga

SEQ ID NO: 31193 - DNA, 22 bp, Artificial Sequence
  Synthetic Construct
caccaagccagtcctggagata

SEQ ID NO: 31194 - DNA, 24 bp, Artificial Sequence
  Synthetic Construct
gaatgatgggagctaggctctaag

SEQ ID NO: 31195 - DNA, 19 bp, Artificial Sequence
  Synthetic Construct
actcccctcgctgggtgat

SEQ ID NO: 31196 - DNA, 26 bp, Artificial Sequence
  Synthetic Construct
gctttctggacttagctcttgtttca

SEQ ID NO: 31197 - DNA, 25 bp, Artificial Sequence
  Synthetic Construct
cttgctagcttcttgggtctcattc

SEQ ID NO: 31198 - DNA, 24 bp, Artificial Sequence
  Synthetic Construct
ctgggaagcagtctttgagaccaa

SEQ ID NO: 31199 - DNA, 22 bp, Artificial Sequence
  Synthetic Construct
ggctagcctccatgtcagcaaa

SEQ ID NO: 31200 - DNA, 22 bp, Artificial Sequence
  Synthetic Construct
ctccacctgccaaaatcctact

SEQ ID NO: 31201 - DNA, 24 bp, Artificial Sequence
  Synthetic Construct
ggtgtgtttgagacccttgcatct

SEQ ID NO: 31202 - DNA, 23 bp, Artificial Sequence
  Synthetic Construct
ctaccgaaagctgttgaccaaac

SEQ ID NO: 31203 - DNA, 23 bp, Artificial Sequence
  Synthetic Construct
cctttgcctgtttcctgcagatt

SEQ ID NO: 31204 - DNA, 24 bp, Artificial Sequence
  Synthetic Construct
agttttccctgaaaggagtgacat

SEQ ID NO: 31205 - DNA, 20 bp, Artificial Sequence
  Synthetic Construct
tgtctgcctcccacatctct

SEQ ID NO: 31206 - DNA, 25 bp, Artificial Sequence
  Synthetic Construct
acaggaccatccaaatcaccttgaa

SEQ ID NO: 31207 - DNA, 27 bp, Artificial Sequence
  Synthetic Construct
cctaaacactggactctttacacatct

SEQ ID NO: 31208 - DNA, 22 bp, Artificial Sequence
  Synthetic Construct
gcacatcacccagttgggaaac

SEQ ID NO: 31209 - DNA, 21 bp, Artificial Sequence
  Synthetic Construct
gggattgggtgttgacgatga

SEQ ID NO: 31210 - DNA, 22 bp, Artificial Sequence
  Synthetic Construct
gacgtgtgtcacgttctcttca

SEQ ID NO: 31211 - DNA, 20 bp, Artificial Sequence
  Synthetic Construct
ccccttgcatttggcacaga

SEQ ID NO: 31212 - DNA, 27 bp, Artificial Sequence
  Synthetic Construct
ctggagggatgtttttcaaacccaaac

SEQ ID NO: 31213 - DNA, 20 bp, Artificial Sequence
  Synthetic Construct
gggcctgaaaactggcatga

SEQ ID NO: 31214 - DNA, 22 bp, Artificial Sequence
  Synthetic Construct
tcgtcaacctgtgcatggtaag

SEQ ID NO: 31215 - DNA, 28 bp, Artificial Sequence
  Synthetic Construct
gcaatcaggacgatcagacaaaaagaag

SEQ ID NO: 31216 - DNA, 21 bp, Artificial Sequence
  Synthetic Construct
ctctgcttttgcaggggttgt

SEQ ID NO: 31217 - DNA, 22 bp, Artificial Sequence
  Synthetic Construct
acccaaggagacaagagcatca

SEQ ID NO: 31218 - DNA, 24 bp, Artificial Sequence
  Synthetic Construct
gaggactggaagtggtaagtcaca

SEQ ID NO: 31219 - DNA, 20 bp, Artificial Sequence
  Synthetic Construct
gcccaagactggcattctca

SEQ ID NO: 31220 - DNA, 23 bp, Artificial Sequence
  Synthetic Construct
acctttttccgactgggatgatt

SEQ ID NO: 31221 - DNA, 23 bp, Artificial Sequence
  Synthetic Construct
cagtcctggattggctgtgatac

SEQ ID NO: 31222 - DNA, 26 bp, Artificial Sequence
  Synthetic Construct
cgcttttggtagcatcagttccttga

SEQ ID NO: 31223 - DNA, 23 bp, Artificial Sequence
  Synthetic Construct
cctagcttgtgccaagaggttct

SEQ ID NO: 31224 - DNA, 21 bp, Artificial Sequence
  Synthetic Construct
ccatttcacggggaaggaagt

SEQ ID NO: 31225 - DNA, 27 bp, Artificial Sequence
  Synthetic Construct
ggcagaggatccctatgttaccagttc

SEQ ID NO: 31226 - DNA, 20 bp, Artificial Sequence
  Synthetic Construct
tgtccctgtggaagccagat

SEQ ID NO: 31227 - DNA, 24 bp, Artificial Sequence
  Synthetic Construct
aagaattgcttcacctagcctgat

SEQ ID NO: 31228 - DNA, 25 bp, Artificial Sequence
  Synthetic Construct
ggccctatacccaacaaagcctcta

SEQ ID NO: 31229 - DNA, 24 bp, Artificial Sequence
  Synthetic Construct
ggggaaccatgaactctacctgaa

SEQ ID NO: 31230 - DNA, 22 bp, Artificial Sequence
  Synthetic Construct
gggacacttacccaaccacgtt

SEQ ID NO: 31231 - DNA, 22 bp, Artificial Sequence
  Synthetic Construct
caccgacttctctgacccaaga

SEQ ID NO: 31232 - DNA, 23 bp, Artificial Sequence
  Synthetic Construct
tgggaaaagtacggagtcagatg

SEQ ID NO: 31233 - DNA, 25 bp, Artificial Sequence
  Synthetic Construct
cgtgtcaactttctccttacctgat

SEQ ID NO: 31234 - DNA, 24 bp, Artificial Sequence
  Synthetic Construct
ggttcagtggagcttgtagtctca

SEQ ID NO: 31235 - DNA, 25 bp, Artificial Sequence
  Synthetic Construct
cacctatgaattcagggctcctttc

SEQ ID NO: 31236 - DNA, 25 bp, Artificial Sequence
  Synthetic Construct
tgggatgggataaggagtaaggaaa

SEQ ID NO: 31237 - DNA, 23 bp, Artificial Sequence
  Synthetic Construct
cccagccagtgaggtagatgttg

SEQ ID NO: 31238 - DNA, 22 bp, Artificial Sequence
  Synthetic Construct
tgccctgtctccttcctttcta

SEQ ID NO: 31239 - DNA, 25 bp, Artificial Sequence
  Synthetic Construct
ggactgtttcccaagtcttcacctt

SEQ ID NO: 31240 - DNA, 20 bp, Artificial Sequence
  Synthetic Construct
agtgtgtccctagcccaagt

SEQ ID NO: 31241 - DNA, 26 bp, Artificial Sequence
  Synthetic Construct
ggcatatatgtaggccgggttgtaag

SEQ ID NO: 31242 - DNA, 24 bp, Artificial Sequence
  Synthetic Construct
ccccgtaacccagatgatgagttt

SEQ ID NO: 31243 - DNA, 24 bp, Artificial Sequence
  Synthetic Construct
aggtagtagacaggcttgaaggtt

SEQ ID NO: 31244 - DNA, 22 bp, Artificial Sequence
  Synthetic Construct
cccggatggggtagcatttcaa

SEQ ID NO: 31245 - DNA, 27 bp, Artificial Sequence
  Synthetic Construct
gcaacaagacttttacccagagaccaa

SEQ ID NO: 31246 - DNA, 23 bp, Artificial Sequence
  Synthetic Construct
ggttccaatggcagactgttgaa

SEQ ID NO: 31247 - DNA, 22 bp, Artificial Sequence
  Synthetic Construct
actggcaaaggagaagggtagt

SEQ ID NO: 31248 - DNA, 22 bp, Artificial Sequence
  Synthetic Construct
tccctgcccaggaccaagaata

SEQ ID NO: 31249 - DNA, 26 bp, Artificial Sequence
  Synthetic Construct
ctgcttattctcctggttgaggttga

SEQ ID NO: 31250 - DNA, 23 bp, Artificial Sequence
  Synthetic Construct
tatgtctcatcccggccctctct

SEQ ID NO: 31251 - DNA, 23 bp, Artificial Sequence
  Synthetic Construct
ccaccacctccgaggatgaaaag

SEQ ID NO: 31252 - DNA, 22 bp, Artificial Sequence
  Synthetic Construct
aggcagccttacacatgacatt

SEQ ID NO: 31253 - DNA, 24 bp, Artificial Sequence
  Synthetic Construct
acatggcctttccactttctcttt

SEQ ID NO: 31254 - DNA, 22 bp, Artificial Sequence
  Synthetic Construct
ctggcgtcgtatgaggcttttg

SEQ ID NO: 31255 - DNA, 26 bp, Artificial Sequence
  Synthetic Construct
ggctgggataaaatgacagtccttga

SEQ ID NO: 31256 - DNA, 20 bp, Artificial Sequence
  Synthetic Construct
gtggtggcttctgtgggttt

SEQ ID NO: 31257 - DNA, 19 bp, Artificial Sequence
  Synthetic Construct
tggcactggtggactcaga

SEQ ID NO: 31258 - DNA, 24 bp, Artificial Sequence
  Synthetic Construct
ccccaactggaataactgttgctt

SEQ ID NO: 31259 - DNA, 24 bp, Artificial Sequence
  Synthetic Construct
gaatgggagaaagagtggtggtat

SEQ ID NO: 31260 - DNA, 23 bp, Artificial Sequence
  Synthetic Construct
gaccgagaagcagtacactgaga

SEQ ID NO: 31261 - DNA, 25 bp, Artificial Sequence
  Synthetic Construct
cagctcatttccctacaggaacagt

SEQ ID NO: 31262 - DNA, 20 bp, Artificial Sequence
  Synthetic Construct
agtgctgggtggccttccta

SEQ ID NO: 31263 - DNA, 23 bp, Artificial Sequence
  Synthetic Construct
cctggtccactaagtgctcttct

SEQ ID NO: 31264 - DNA, 22 bp, Artificial Sequence
  Synthetic Construct
gggagcatcagccatccatcat

SEQ ID NO: 31265 - DNA, 29 bp, Artificial Sequence
  Synthetic Construct
ctcgaaactcattcatcttcctgtgtaag

SEQ ID NO: 31266 - DNA, 24 bp, Artificial Sequence
  Synthetic Construct
tcagtgctaccatcagggatatga

SEQ ID NO: 31267 - DNA, 20 bp, Artificial Sequence
  Synthetic Construct
cctcgctggaagacgggaaa

SEQ ID NO: 31268 - DNA, 18 bp, Artificial Sequence
  Synthetic Construct
gcagtgcctctgctccaa

SEQ ID NO: 31269 - DNA, 25 bp, Artificial Sequence
  Synthetic Construct
ggcataaaagaggatcacgttcaca

SEQ ID NO: 31270 - DNA, 21 bp, Artificial Sequence
  Synthetic Construct
tgagcctagtggaggtcactt

SEQ ID NO: 31271 - DNA, 27 bp, Artificial Sequence
  Synthetic Construct
ccacaataattggtgactgacttgcta

SEQ ID NO: 31272 - DNA, 23 bp, Artificial Sequence
  Synthetic Construct
tgcctagtggttcacgagttaga

SEQ ID NO: 31273 - DNA, 23 bp, Artificial Sequence
  Synthetic Construct
gggttcctgacctgcaaatctct

SEQ ID NO: 31274 - DNA, 25 bp, Artificial Sequence
  Synthetic Construct
gcaagaaagcatccatccatctaca

SEQ ID NO: 31275 - DNA, 25 bp, Artificial Sequence
  Synthetic Construct
ctgtagctttcctgtgactggtttc

SEQ ID NO: 31276 - DNA, 22 bp, Artificial Sequence
  Synthetic Construct
ggggcagaggggactaaggtaa

SEQ ID NO: 31277 - DNA, 27 bp, Artificial Sequence
  Synthetic Construct
ctcctccaaccttaacacctagatatg

SEQ ID NO: 31278 - DNA, 23 bp, Artificial Sequence
  Synthetic Construct
cagctcccctcaaagtcagatag

SEQ ID NO: 31279 - DNA, 25 bp, Artificial Sequence
  Synthetic Construct
gcaaaggagaccatcttcattccaa

SEQ ID NO: 31280 - DNA, 22 bp, Artificial Sequence
  Synthetic Construct
cgcaaaggcccaggaaaagaca

SEQ ID NO: 31281 - DNA, 22 bp, Artificial Sequence
  Synthetic Construct
gggcgggcttattaccttcttg

SEQ ID NO: 31282 - DNA, 22 bp, Artificial Sequence
  Synthetic Construct
gtgtaggactcagccatgttca

SEQ ID NO: 31283 - DNA, 20 bp, Artificial Sequence
  Synthetic Construct
gaagcccagcaagtggatca

SEQ ID NO: 31284 - DNA, 24 bp, Artificial Sequence
  Synthetic Construct
aggaggtgcttgtattgacacttg

SEQ ID NO: 31285 - DNA, 19 bp, Artificial Sequence
  Synthetic Construct
ccacggagcagctggaaca

SEQ ID NO: 31286 - DNA, 21 bp, Artificial Sequence
  Synthetic Construct
cggtaccccaggttcttctgt

SEQ ID NO: 31287 - DNA, 22 bp, Artificial Sequence
  Synthetic Construct
agccagcactagcctcttatgt

SEQ ID NO: 31288 - DNA, 22 bp, Artificial Sequence
  Synthetic Construct
gggactctcccttgaccttgaa

SEQ ID NO: 31289 - DNA, 24 bp, Artificial Sequence
  Synthetic Construct
caggagtagagtaggaaggctgta

SEQ ID NO: 31290 - DNA, 21 bp, Artificial Sequence
  Synthetic Construct
ccagctgtgacgcatggatga

SEQ ID NO: 31291 - DNA, 24 bp, Artificial Sequence
  Synthetic Construct
ggatgtctggggaagaagatgact

SEQ ID NO: 31292 - DNA, 20 bp, Artificial Sequence
  Synthetic Construct
tcctggggcccgactcatag

SEQ ID NO: 31293 - DNA, 24 bp, Artificial Sequence
  Synthetic Construct
gccccttgtcactcagtcaaaaac

SEQ ID NO: 31294 - DNA, 26 bp, Artificial Sequence
  Synthetic Construct
gcaatccaagaggttagtgactgttc

SEQ ID NO: 31295 - DNA, 21 bp, Artificial Sequence
  Synthetic Construct
agccagtcccacgtcacatag

SEQ ID NO: 31296 - DNA, 24 bp, Artificial Sequence
  Synthetic Construct
aactgaaaaagggttccctcactt

SEQ ID NO: 31297 - DNA, 22 bp, Artificial Sequence
  Synthetic Construct
gcccctggaccataaccaaagt

SEQ ID NO: 31298 - DNA, 19 bp, Artificial Sequence
  Synthetic Construct
cggccatagcccacaggaa

SEQ ID NO: 31299 - DNA, 22 bp, Artificial Sequence
  Synthetic Construct
tcagggcctgtaatgtgctatg

SEQ ID NO: 31300 - DNA, 25 bp, Artificial Sequence
  Synthetic Construct
atccatcttccacaatgtcaccata

SEQ ID NO: 31301 - DNA, 22 bp, Artificial Sequence
  Synthetic Construct
gctgggctgcaggtatgaatct

SEQ ID NO: 31302 - DNA, 21 bp, Artificial Sequence
  Synthetic Construct
gagctagctgcaggagttgtt

SEQ ID NO: 31303 - DNA, 24 bp, Artificial Sequence
  Synthetic Construct
tgggatagcatggctggattatct

SEQ ID NO: 31304 - DNA, 24 bp, Artificial Sequence
  Synthetic Construct
gatccaacagccactaagtgaaac

SEQ ID NO: 31305 - DNA, 24 bp, Artificial Sequence
  Synthetic Construct
tcccacggtctagattttgttgat

SEQ ID NO: 31306 - DNA, 21 bp, Artificial Sequence
  Synthetic Construct
gcatgttgggagcagaaccaa

SEQ ID NO: 31307 - DNA, 22 bp, Artificial Sequence
  Synthetic Construct
aggctgccagatcagtggtttc

SEQ ID NO: 31308 - DNA, 26 bp, Artificial Sequence
  Synthetic Construct
ctctcatcaactcacaatggcgtttt

SEQ ID NO: 31309 - DNA, 21 bp, Artificial Sequence
  Synthetic Construct
tccagcagacccagggtgtaa

SEQ ID NO: 31310 - DNA, 23 bp, Artificial Sequence
  Synthetic Construct
gacaatggacacacactccagtt

SEQ ID NO: 31311 - DNA, 24 bp, Artificial Sequence
  Synthetic Construct
agaggtttgcacttcagagacatc

SEQ ID NO: 31312 - DNA, 22 bp, Artificial Sequence
  Synthetic Construct
gctgcctggagacagtgcatag

SEQ ID NO: 31313 - DNA, 26 bp, Artificial Sequence
  Synthetic Construct
cctctgtgttgaagctttgagaatac

SEQ ID NO: 31314 - DNA, 22 bp, Artificial Sequence
  Synthetic Construct
ggaagctgccagtctactgtgt

SEQ ID NO: 31315 - DNA, 23 bp, Artificial Sequence
  Synthetic Construct
aggtacaaacaccaacctcacat

SEQ ID NO: 31316 - DNA, 24 bp, Artificial Sequence
  Synthetic Construct
tgtcttcacactttagggagcttt

SEQ ID NO: 31317 - DNA, 21 bp, Artificial Sequence
  Synthetic Construct
agctttacccctcctctgaca

SEQ ID NO: 31318 - DNA, 27 bp, Artificial Sequence
  Synthetic Construct
cctaggaagaggaacagatttggtaag

SEQ ID NO: 31319 - DNA, 26 bp, Artificial Sequence
  Synthetic Construct
cccaagaaaggtctgttctgactgta

SEQ ID NO: 31320 - DNA, 21 bp, Artificial Sequence
  Synthetic Construct
agctcagatccaccccagcat

SEQ ID NO: 31321 - DNA, 24 bp, Artificial Sequence
  Synthetic Construct
ctgtgtctgttggatgcgtagtga

SEQ ID NO: 31322 - DNA, 26 bp, Artificial Sequence
  Synthetic Construct
gggtccactgtagttcatttccctaa

SEQ ID NO: 31323 - DNA, 20 bp, Artificial Sequence
  Synthetic Construct
actggggctgcagttaccta

SEQ ID NO: 31324 - DNA, 21 bp, Artificial Sequence
  Synthetic Construct
ggccctttaccccaccctgta

SEQ ID NO: 31325 - DNA, 25 bp, Artificial Sequence
  Synthetic Construct
ccaattggaggaaggatgacctatc

SEQ ID NO: 31326 - DNA, 24 bp, Artificial Sequence
  Synthetic Construct
gtcatccgtcttctctcaccctta

SEQ ID NO: 31327 - DNA, 27 bp, Artificial Sequence
  Synthetic Construct
gtctgtctgccaaatctatgcagtttc

SEQ ID NO: 31328 - DNA, 22 bp, Artificial Sequence
  Synthetic Construct
gcttagcggaggttccctgaat

SEQ ID NO: 31329 - DNA, 19 bp, Artificial Sequence
  Synthetic Construct
aggcccaggagtggaccta

SEQ ID NO: 31330 - DNA, 26 bp, Artificial Sequence
  Synthetic Construct
gtgttctgttgaaccattgggtatgt

SEQ ID NO: 31331 - DNA, 25 bp, Artificial Sequence
  Synthetic Construct
gggtcagagaagctcaaccttggaa

SEQ ID NO: 31332 - DNA, 25 bp, Artificial Sequence
  Synthetic Construct
ggctctaacagcttttgtcatgttt

SEQ ID NO: 31333 - DNA, 28 bp, Artificial Sequence
  Synthetic Construct
gctgaaagttaaaggaactggtggattc

SEQ ID NO: 31334 - DNA, 25 bp, Artificial Sequence
  Synthetic Construct
tctgctcttgtactgttctgctatt

SEQ ID NO: 31335 - DNA, 27 bp, Artificial Sequence
  Synthetic Construct
ggacactgtttgctttgtgtgagtaaa

SEQ ID NO: 31336 - DNA, 22 bp, Artificial Sequence
  Synthetic Construct
ggagagtgtcccagactgatct

SEQ ID NO: 31337 - DNA, 22 bp, Artificial Sequence
  Synthetic Construct
ccacgccgagctgtgaaatagt

SEQ ID NO: 31338 - DNA, 23 bp, Artificial Sequence
  Synthetic Construct
tcttctccctgtcctgtctttct

SEQ ID NO: 31339 - DNA, 24 bp, Artificial Sequence
  Synthetic Construct
gcctgtggacacagctttgtttct

SEQ ID NO: 31340 - DNA, 24 bp, Artificial Sequence
  Synthetic Construct
cggctacttccttttgccttaaaa

SEQ ID NO: 31341 - DNA, 22 bp, Artificial Sequence
  Synthetic Construct
gtctaggccacgaggtcttcaa

SEQ ID NO: 31342 - DNA, 22 bp, Artificial Sequence
  Synthetic Construct
ccatagtccagtgtggctgcat

SEQ ID NO: 31343 - DNA, 25 bp, Artificial Sequence
  Synthetic Construct
aaaattcaggctgacaggtaagcta

SEQ ID NO: 31344 - DNA, 20 bp, Artificial Sequence
  Synthetic Construct
gcatggtggtgtgcatctgt

SEQ ID NO: 31345 - DNA, 24 bp, Artificial Sequence
  Synthetic Construct
gcaggctagaagggcaaagggata

SEQ ID NO: 31346 - DNA, 24 bp, Artificial Sequence
  Synthetic Construct
cctgtctacaaatggtccctgact

SEQ ID NO: 31347 - DNA, 27 bp, Artificial Sequence
  Synthetic Construct
cacattgttaccctataacggtgttgt

SEQ ID NO: 31348 - DNA, 26 bp, Artificial Sequence
  Synthetic Construct
ggaaatagctgggtgttgctactaag

SEQ ID NO: 31349 - DNA, 29 bp, Artificial Sequence
  Synthetic Construct
ctgaagttggtatccctttagcttcaaac

SEQ ID NO: 31350 - DNA, 21 bp, Artificial Sequence
  Synthetic Construct
tcctccttggcccaatcaaag

SEQ ID NO: 31351 - DNA, 21 bp, Artificial Sequence
  Synthetic Construct
attggctaagcaggccaatct

SEQ ID NO: 31352 - DNA, 24 bp, Artificial Sequence
  Synthetic Construct
acctggtgttctagtctactgtga

SEQ ID NO: 31353 - DNA, 24 bp, Artificial Sequence
  Synthetic Construct
acttggggaacagaaagatgtcaa

SEQ ID NO: 31354 - DNA, 22 bp, Artificial Sequence
  Synthetic Construct
ccaccaggagctcagttgtgtt

SEQ ID NO: 31355 - DNA, 21 bp, Artificial Sequence
  Synthetic Construct
gtggttactgcatcggacagt

SEQ ID NO: 31356 - DNA, 20 bp, Artificial Sequence
  Synthetic Construct
gggaaatgcttcgggacctt

SEQ ID NO: 31357 - DNA, 20 bp, Artificial Sequence
  Synthetic Construct
ctttgggctggttggtctga

SEQ ID NO: 31358 - DNA, 21 bp, Artificial Sequence
  Synthetic Construct
agtgatggctcctgcccaaac

SEQ ID NO: 31359 - DNA, 22 bp, Artificial Sequence
  Synthetic Construct
gccctcccaggctaagaatatc

SEQ ID NO: 31360 - DNA, 23 bp, Artificial Sequence
  Synthetic Construct
cctaagccttctgcagctgaaat

SEQ ID NO: 31361 - DNA, 21 bp, Artificial Sequence
  Synthetic Construct
gtgaagcagctggaagtctct

SEQ ID NO: 31362 - DNA, 23 bp, Artificial Sequence
  Synthetic Construct
actgcctcccatttccattttct

SEQ ID NO: 31363 - DNA, 26 bp, Artificial Sequence
  Synthetic Construct
cttcactacgtagatgccatcctatt

SEQ ID NO: 31364 - DNA, 22 bp, Artificial Sequence
  Synthetic Construct
gaccctctgtgtctttgtgcat

SEQ ID NO: 31365 - DNA, 20 bp, Artificial Sequence
  Synthetic Construct
agctgcctcccagagaagat

SEQ ID NO: 31366 - DNA, 20 bp, Artificial Sequence
  Synthetic Construct
agtcgctgtggggaaaggaa

SEQ ID NO: 31367 - DNA, 20 bp, Artificial Sequence
  Synthetic Construct
ggcttcacggctgaaaggat

SEQ ID NO: 31368 - DNA, 19 bp, Artificial Sequence
  Synthetic Construct
tggcaaggcatccccaaga

SEQ ID NO: 31369 - DNA, 23 bp, Artificial Sequence
  Synthetic Construct
gtttctgccagttaggagctagt

SEQ ID NO: 31370 - DNA, 23 bp, Artificial Sequence
  Synthetic Construct
ggactccagaagcttcagacaac

SEQ ID NO: 31371 - DNA, 24 bp, Artificial Sequence
  Synthetic Construct
ggcaacagaacaagacctggtgaa

SEQ ID NO: 31372 - DNA, 24 bp, Artificial Sequence
  Synthetic Construct
gcacgaagaccatttaggaaaaca

SEQ ID NO: 31373 - DNA, 27 bp, Artificial Sequence
  Synthetic Construct
ctataacttccagtaactgtgctcctt

SEQ ID NO: 31374 - DNA, 21 bp, Artificial Sequence
  Synthetic Construct
ccccacctagccactctctac

SEQ ID NO: 31375 - DNA, 27 bp, Artificial Sequence
  Synthetic Construct
ggggagggaagaagaagcataatgtca

SEQ ID NO: 31376 - DNA, 22 bp, Artificial Sequence
  Synthetic Construct
ggacctgctcctttctgtccaa

SEQ ID NO: 31377 - DNA, 22 bp, Artificial Sequence
  Synthetic Construct
gccacctttcaggacttgctaa

SEQ ID NO: 31378 - DNA, 22 bp, Artificial Sequence
  Synthetic Construct
ccgtttcaggccatagctcaca

SEQ ID NO: 31379 - DNA, 22 bp, Artificial Sequence
  Synthetic Construct
ctggttctcaggtcctgccttt

SEQ ID NO: 31380 - DNA, 20 bp, Artificial Sequence
  Synthetic Construct
tccagggcagtgcctccttt

SEQ ID NO: 31381 - DNA, 27 bp, Artificial Sequence
  Synthetic Construct
gctttccttttagtccgccttaagatt

SEQ ID NO: 31382 - DNA, 23 bp, Artificial Sequence
  Synthetic Construct
ttctctggccagcctttaagttt

SEQ ID NO: 31383 - DNA, 21 bp, Artificial Sequence
  Synthetic Construct
ctcaaggccagtcagctctgt

SEQ ID NO: 31384 - DNA, 23 bp, Artificial Sequence
  Synthetic Construct
ctgttcatggcatcccctaatgt

SEQ ID NO: 31385 - DNA, 26 bp, Artificial Sequence
  Synthetic Construct
cagcctagtgttttgtgaccatctgt

SEQ ID NO: 31386 - DNA, 23 bp, Artificial Sequence
  Synthetic Construct
gccaaacaaagggagcactggtt

SEQ ID NO: 31387 - DNA, 22 bp, Artificial Sequence
  Synthetic Construct
actgcagcaactatgcatcaca

SEQ ID NO: 31388 - DNA, 23 bp, Artificial Sequence
  Synthetic Construct
ggcttctctccctaccccagatt

SEQ ID NO: 31389 - DNA, 22 bp, Artificial Sequence
  Synthetic Construct
aatggggaagggctgtgagtag

SEQ ID NO: 31390 - DNA, 22 bp, Artificial Sequence
  Synthetic Construct
cttccctatccagctggtcact

SEQ ID NO: 31391 - DNA, 24 bp, Artificial Sequence
  Synthetic Construct
gcagcaggtgataatgcagaattg

SEQ ID NO: 31392 - DNA, 20 bp, Artificial Sequence
  Synthetic Construct
atctgtccgcagagggcttt

SEQ ID NO: 31393 - DNA, 27 bp, Artificial Sequence
  Synthetic Construct
ggaatcccatgtaaggtacttgctgtt

SEQ ID NO: 31394 - DNA, 26 bp, Artificial Sequence
  Synthetic Construct
gtgggcttagatttgggatattggta

SEQ ID NO: 31395 - DNA, 21 bp, Artificial Sequence
  Synthetic Construct
agtggggttttgcagcctatc

SEQ ID NO: 31396 - DNA, 21 bp, Artificial Sequence
  Synthetic Construct
cctggaaaacaccacgctctt

SEQ ID NO: 31397 - DNA, 27 bp, Artificial Sequence
  Synthetic Construct
gagaagacgacaggttcatttgctttg

SEQ ID NO: 31398 - DNA, 20 bp, Artificial Sequence
  Synthetic Construct
gcagggcatgactgacttct

SEQ ID NO: 31399 - DNA, 24 bp, Artificial Sequence
  Synthetic Construct
gtgtccatgcctctaggacatcat

SEQ ID NO: 31400 - DNA, 25 bp, Artificial Sequence
  Synthetic Construct
ccagtagtgcagttccagtctgagt

SEQ ID NO: 31401 - DNA, 24 bp, Artificial Sequence
  Synthetic Construct
gcactaaccctcctgccagagaaa

SEQ ID NO: 31402 - DNA, 22 bp, Artificial Sequence
  Synthetic Construct
ctccaccatcaagaccgtttct

SEQ ID NO: 31403 - DNA, 23 bp, Artificial Sequence
  Synthetic Construct
gggcaggggatggataggagaaa

SEQ ID NO: 31404 - DNA, 29 bp, Artificial Sequence
  Synthetic Construct
cctgtttctcatgcatacttagccatgtt

SEQ ID NO: 31405 - DNA, 24 bp, Artificial Sequence
  Synthetic Construct
ctcctgacaaaataacggctggaa

SEQ ID NO: 31406 - DNA, 23 bp, Artificial Sequence
  Synthetic Construct
agcttgaagtaagccccttcatc

SEQ ID NO: 31407 - DNA, 26 bp, Artificial Sequence
  Synthetic Construct
ccttagtcaatgcaatgggaaagcta

SEQ ID NO: 31408 - DNA, 24 bp, Artificial Sequence
  Synthetic Construct
ggagctggtagagccagaattcaa

SEQ ID NO: 31409 - DNA, 20 bp, Artificial Sequence
  Synthetic Construct
aagactgccaggtggaggtt

SEQ ID NO: 31410 - DNA, 23 bp, Artificial Sequence
  Synthetic Construct
gaaacaccatcccacacagatga

SEQ ID NO: 31411 - DNA, 27 bp, Artificial Sequence
  Synthetic Construct
gagaagccttttgaatgctgttactgt

SEQ ID NO: 31412 - DNA, 25 bp, Artificial Sequence
  Synthetic Construct
gtgaggagttgtttgtgagctttag

SEQ ID NO: 31413 - DNA, 24 bp, Artificial Sequence
  Synthetic Construct
ccaacaggtagttttccagctctt

SEQ ID NO: 31414 - DNA, 23 bp, Artificial Sequence
  Synthetic Construct
ggcagagtagcatttctgcaaac

SEQ ID NO: 31415 - DNA, 23 bp, Artificial Sequence
  Synthetic Construct
ttgcaagccacttatcaggaagt

SEQ ID NO: 31416 - DNA, 25 bp, Artificial Sequence
  Synthetic Construct
gtaagctgctgaaactgatggtaag

SEQ ID NO: 31417 - DNA, 22 bp, Artificial Sequence
  Synthetic Construct
gctggcccaggaaagaagagtt

SEQ ID NO: 31418 - DNA, 24 bp, Artificial Sequence
  Synthetic Construct
tcatcctcaaagggtcctttttca

SEQ ID NO: 31419 - DNA, 27 bp, Artificial Sequence
  Synthetic Construct
ccctccagtatcacagtcttccttttg

SEQ ID NO: 31420 - DNA, 23 bp, Artificial Sequence
  Synthetic Construct
actgagcactgacctgaatgaat

SEQ ID NO: 31421 - DNA, 25 bp, Artificial Sequence
  Synthetic Construct
cataggtacatgcacttggctaaag

SEQ ID NO: 31422 - DNA, 22 bp, Artificial Sequence
  Synthetic Construct
ccctgcagcctcatttcttact

SEQ ID NO: 31423 - DNA, 20 bp, Artificial Sequence
  Synthetic Construct
tgcagggcctgggtataact

SEQ ID NO: 31424 - DNA, 24 bp, Artificial Sequence
  Synthetic Construct
acagagagccagcgagatattttt

SEQ ID NO: 31425 - DNA, 24 bp, Artificial Sequence
  Synthetic Construct
gcagcaaattgcagagaacacatc

SEQ ID NO: 31426 - DNA, 23 bp, Artificial Sequence
  Synthetic Construct
ggaggccatggaacatgtagaac

SEQ ID NO: 31427 - DNA, 26 bp, Artificial Sequence
  Synthetic Construct
gcataatggagagggaaacttgtgat

SEQ ID NO: 31428 - DNA, 25 bp, Artificial Sequence
  Synthetic Construct
ccctaaagtgcttgcttttgtctac

SEQ ID NO: 31429 - DNA, 23 bp, Artificial Sequence
  Synthetic Construct
ggaaatcatgtggcgtcccttct

SEQ ID NO: 31430 - DNA, 23 bp, Artificial Sequence
  Synthetic Construct
agaccgtcctcctcttaatggaa

SEQ ID NO: 31431 - DNA, 20 bp, Artificial Sequence
  Synthetic Construct
tcccttcgcctgagctcctt

SEQ ID NO: 31432 - DNA, 21 bp, Artificial Sequence
  Synthetic Construct
cgactactccccgtgtctttc

SEQ ID NO: 31433 - DNA, 24 bp, Artificial Sequence
  Synthetic Construct
gcctcatccaaagtcatgctccat

SEQ ID NO: 31434 - DNA, 25 bp, Artificial Sequence
  Synthetic Construct
gccagctcacaaaataactctgttc

SEQ ID NO: 31435 - DNA, 25 bp, Artificial Sequence
  Synthetic Construct
gaaacgttttgtggggaattaggaa

SEQ ID NO: 31436 - DNA, 24 bp, Artificial Sequence
  Synthetic Construct
ggtggcaggaaacttaaggccaat

SEQ ID NO: 31437 - DNA, 25 bp, Artificial Sequence
  Synthetic Construct
ggagaaaccagcacaaagaggctaa

SEQ ID NO: 31438 - DNA, 24 bp, Artificial Sequence
  Synthetic Construct
gcagggaagtcctagttgcactct

SEQ ID NO: 31439 - DNA, 27 bp, Artificial Sequence
  Synthetic Construct
cggattatttagcagttgggtaagaag

SEQ ID NO: 31440 - DNA, 23 bp, Artificial Sequence
  Synthetic Construct
gcttccttttccttcggcattag

SEQ ID NO: 31441 - DNA, 25 bp, Artificial Sequence
  Synthetic Construct
gggatgaattgctgggatgatgttc

SEQ ID NO: 31442 - DNA, 25 bp, Artificial Sequence
  Synthetic Construct
gcatcagccagtaaaggaactgaga

SEQ ID NO: 31443 - DNA, 24 bp, Artificial Sequence
  Synthetic Construct
gtgccttgtgactgggatacattc

SEQ ID NO: 31444 - DNA, 25 bp, Artificial Sequence
  Synthetic Construct
gaagggaggaaaatggagaggaatc

SEQ ID NO: 31445 - DNA, 22 bp, Artificial Sequence
  Synthetic Construct
tgttatccccaggttccagtct

SEQ ID NO: 31446 - DNA, 24 bp, Artificial Sequence
  Synthetic Construct
ctttggataccagaaccccacttc

SEQ ID NO: 31447 - DNA, 23 bp, Artificial Sequence
  Synthetic Construct
agcaaggaaatgtggctcaaaag

SEQ ID NO: 31448 - DNA, 26 bp, Artificial Sequence
  Synthetic Construct
ccagcacagtagtttttggtctgctt

SEQ ID NO: 31449 - DNA, 25 bp, Artificial Sequence
  Synthetic Construct
gcaagggtccatctcaagaacacat

SEQ ID NO: 31450 - DNA, 24 bp, Artificial Sequence
  Synthetic Construct
cccctatccagcaggaatggtttc

SEQ ID NO: 31451 - DNA, 27 bp, Artificial Sequence
  Synthetic Construct
ggggaagtttcctttactagtgccatt

SEQ ID NO: 31452 - DNA, 22 bp, Artificial Sequence
  Synthetic Construct
cccgatgagagccaaagactga

SEQ ID NO: 31453 - DNA, 26 bp, Artificial Sequence
  Synthetic Construct
ctggactccataccactgaactgatg

SEQ ID NO: 31454 - DNA, 22 bp, Artificial Sequence
  Synthetic Construct
gggcaaagacgtggaagtgaga

SEQ ID NO: 31455 - DNA, 25 bp, Artificial Sequence
  Synthetic Construct
gcagagaatgttttatgctgggatt

SEQ ID NO: 31456 - DNA, 22 bp, Artificial Sequence
  Synthetic Construct
ggccaaggcaatctcagagaag

SEQ ID NO: 31457 - DNA, 23 bp, Artificial Sequence
  Synthetic Construct
cctgcagtagccagttgaaccta

SEQ ID NO: 31458 - DNA, 21 bp, Artificial Sequence
  Synthetic Construct
gtgccctttgtgtgagagcaa

SEQ ID NO: 31459 - DNA, 25 bp, Artificial Sequence
  Synthetic Construct
gcatttgtggctgaccatagataag

SEQ ID NO: 31460 - DNA, 20 bp, Artificial Sequence
  Synthetic Construct
agctgcagagttggggtttc

SEQ ID NO: 31461 - DNA, 23 bp, Artificial Sequence
  Synthetic Construct
tgccaaccccaagtagctttaat

SEQ ID NO: 31462 - DNA, 20 bp, Artificial Sequence
  Synthetic Construct
agacagctccctacgagcaa

SEQ ID NO: 31463 - DNA, 21 bp, Artificial Sequence
  Synthetic Construct
gcctctgccgggtaaaagtca

SEQ ID NO: 31464 - DNA, 21 bp, Artificial Sequence
  Synthetic Construct
ccatcaccatcgtagctgaca

SEQ ID NO: 31465 - DNA, 30 bp, Artificial Sequence
  Synthetic Construct
gctcaacaactatccagtttcatcctaaag

SEQ ID NO: 31466 - DNA, 25 bp, Artificial Sequence
  Synthetic Construct
gggtctcttggacacttgtttcttc

SEQ ID NO: 31467 - DNA, 23 bp, Artificial Sequence
  Synthetic Construct
caagtgccactgatgctttacaa

SEQ ID NO: 31468 - DNA, 26 bp, Artificial Sequence
  Synthetic Construct
ggaaaagactggaacaagactactga

SEQ ID NO: 31469 - DNA, 25 bp, Artificial Sequence
  Synthetic Construct
tgattgcccttaagtgacatgaagt

SEQ ID NO: 31470 - DNA, 20 bp, Artificial Sequence
  Synthetic Construct
ccctcccctgacaccttact

SEQ ID NO: 31471 - DNA, 23 bp, Artificial Sequence
  Synthetic Construct
gtcctggatgaggggaatgagtt

SEQ ID NO: 31472 - DNA, 25 bp, Artificial Sequence
  Synthetic Construct
ctgaatagacctatcttgccacaca

SEQ ID NO: 31473 - DNA, 24 bp, Artificial Sequence
  Synthetic Construct
gtccttggatcagctaaggcatgt

SEQ ID NO: 31474 - DNA, 24 bp, Artificial Sequence
  Synthetic Construct
gctgagaacttgccttaggctaca

SEQ ID NO: 31475 - DNA, 22 bp, Artificial Sequence
  Synthetic Construct
tgatggccccatctctgagtct

SEQ ID NO: 31476 - DNA, 27 bp, Artificial Sequence
  Synthetic Construct
cagtgtttgcatgggactttcttcatc

SEQ ID NO: 31477 - DNA, 22 bp, Artificial Sequence
  Synthetic Construct
caacacacaaggggtggagttg

SEQ ID NO: 31478 - DNA, 21 bp, Artificial Sequence
  Synthetic Construct
gctgggagactgtgggtcaga

SEQ ID NO: 31479 - DNA, 27 bp, Artificial Sequence
  Synthetic Construct
ctggacaggctaaataatggtggaatc

SEQ ID NO: 31480 - DNA, 22 bp, Artificial Sequence
  Synthetic Construct
gggccactttgtacgtggctat

SEQ ID NO: 31481 - DNA, 26 bp, Artificial Sequence
  Synthetic Construct
tggacttagggtaccatctactcttg

SEQ ID NO: 31482 - DNA, 23 bp, Artificial Sequence
  Synthetic Construct
tcctctaacacctgtgccatttg

SEQ ID NO: 31483 - DNA, 23 bp, Artificial Sequence
  Synthetic Construct
cagatggaggacaaagcctcaga

SEQ ID NO: 31484 - DNA, 24 bp, Artificial Sequence
  Synthetic Construct
accaacctccttaagggaaaggat

SEQ ID NO: 31485 - DNA, 22 bp, Artificial Sequence
  Synthetic Construct
gtggcaagccaggacaactgta

SEQ ID NO: 31486 - DNA, 25 bp, Artificial Sequence
  Synthetic Construct
aaaggaatatgggttcttggctaca

SEQ ID NO: 31487 - DNA, 22 bp, Artificial Sequence
  Synthetic Construct
tggtagttcctcctgcgttcat

SEQ ID NO: 31488 - DNA, 30 bp, Artificial Sequence
  Synthetic Construct
ccattacctagttgtaaccaatacctgact

SEQ ID NO: 31489 - DNA, 20 bp, Artificial Sequence
  Synthetic Construct
ctgccagcacggctaaaatg

SEQ ID NO: 31490 - DNA, 24 bp, Artificial Sequence
  Synthetic Construct
ggagcataaactcccaggcacttc

SEQ ID NO: 31491 - DNA, 27 bp, Artificial Sequence
  Synthetic Construct
ctcctagctctttaatcctttcactgt

SEQ ID NO: 31492 - DNA, 27 bp, Artificial Sequence
  Synthetic Construct
ggctgataaccgggtgattatacaact

SEQ ID NO: 31493 - DNA, 21 bp, Artificial Sequence
  Synthetic Construct
ttccccgaagcccacagtcta

SEQ ID NO: 31494 - DNA, 19 bp, Artificial Sequence
  Synthetic Construct
tgggctcacggcaagttca

SEQ ID NO: 31495 - DNA, 18 bp, Artificial Sequence
  Synthetic Construct
tgcatgcacctgctgtga

SEQ ID NO: 31496 - DNA, 23 bp, Artificial Sequence
  Synthetic Construct
tgtaccctaggtaccagctcatc

SEQ ID NO: 31497 - DNA, 22 bp, Artificial Sequence
  Synthetic Construct
tccacttctcacctctccttca

SEQ ID NO: 31498 - DNA, 21 bp, Artificial Sequence
  Synthetic Construct
gggaggctcgagtggcttatg

SEQ ID NO: 31499 - DNA, 25 bp, Artificial Sequence
  Synthetic Construct
cacgtgtaaatgacagggacacatc

SEQ ID NO: 31500 - DNA, 22 bp, Artificial Sequence
  Synthetic Construct
gcttgggagggtacacagtgat

SEQ ID NO: 31501 - DNA, 26 bp, Artificial Sequence
  Synthetic Construct
ctggaaggaggaaaatgacataggat

SEQ ID NO: 31502 - DNA, 25 bp, Artificial Sequence
  Synthetic Construct
acctaagaaaagcagaggaaacagt

SEQ ID NO: 31503 - DNA, 20 bp, Artificial Sequence
  Synthetic Construct
tgccccagctagtggaaagt

SEQ ID NO: 31504 - DNA, 26 bp, Artificial Sequence
  Synthetic Construct
caccaattatgccctagcctaagaag

SEQ ID NO: 31505 - DNA, 29 bp, Artificial Sequence
  Synthetic Construct
gtgccactagggttgaatttatcatgttc

SEQ ID NO: 31506 - DNA, 20 bp, Artificial Sequence
  Synthetic Construct
ttgctcccacagctccattg

SEQ ID NO: 31507 - DNA, 24 bp, Artificial Sequence
  Synthetic Construct
atctgttccacgagatgttgatga

SEQ ID NO: 31508 - DNA, 20 bp, Artificial Sequence
  Synthetic Construct
ctcacagccagtgcagaagt

SEQ ID NO: 31509 - DNA, 22 bp, Artificial Sequence
  Synthetic Construct
gtgccttcaccccatctgacaa

SEQ ID NO: 31510 - DNA, 24 bp, Artificial Sequence
  Synthetic Construct
gtctaaggtgtgagcaggatgttg

SEQ ID NO: 31511 - DNA, 23 bp, Artificial Sequence
  Synthetic Construct
cctggtctgtttgcactctccaa

SEQ ID NO: 31512 - DNA, 27 bp, Artificial Sequence
  Synthetic Construct
gggtggaagttttgagattatctggtt

SEQ ID NO: 31513 - DNA, 23 bp, Artificial Sequence
  Synthetic Construct
acccatttgttcccaagttgttg

SEQ ID NO: 31514 - DNA, 26 bp, Artificial Sequence
  Synthetic Construct
ggtggttgggtgcagtaaaatagtca

SEQ ID NO: 31515 - DNA, 23 bp, Artificial Sequence
  Synthetic Construct
tggataccctttcggtgacatct

SEQ ID NO: 31516 - DNA, 25 bp, Artificial Sequence
  Synthetic Construct
ctccacaactggagaaacacatgat

SEQ ID NO: 31517 - DNA, 24 bp, Artificial Sequence
  Synthetic Construct
tcacatagcgcagaggtagaaatg

SEQ ID NO: 31518 - DNA, 22 bp, Artificial Sequence
  Synthetic Construct
agctcacctaaaccaagtgcaa

SEQ ID NO: 31519 - DNA, 24 bp, Artificial Sequence
  Synthetic Construct
caggagctcttcccactgatcttg

SEQ ID NO: 31520 - DNA, 23 bp, Artificial Sequence
  Synthetic Construct
ggtgctgttgctaaaggctcaca

SEQ ID NO: 31521 - DNA, 24 bp, Artificial Sequence
  Synthetic Construct
ccagaggtccttttcccaacagat

SEQ ID NO: 31522 - DNA, 29 bp, Artificial Sequence
  Synthetic Construct
gcagagagtacaaatagcagtaagcagtt

SEQ ID NO: 31523 - DNA, 24 bp, Artificial Sequence
  Synthetic Construct
gactccctgtgaccttgaacagat

SEQ ID NO: 31524 - DNA, 22 bp, Artificial Sequence
  Synthetic Construct
ctgatccagctcgcagagtcta

SEQ ID NO: 31525 - DNA, 27 bp, Artificial Sequence
  Synthetic Construct
catggatcgttaaatgtagcaggatct

SEQ ID NO: 31526 - DNA, 24 bp, Artificial Sequence
  Synthetic Construct
ggcttagcaatttccactcggatt

SEQ ID NO: 31527 - DNA, 24 bp, Artificial Sequence
  Synthetic Construct
cagtggagaactggggtctcatag

SEQ ID NO: 31528 - DNA, 22 bp, Artificial Sequence
  Synthetic Construct
tgagctccttgacgacaggaat

SEQ ID NO: 31529 - DNA, 20 bp, Artificial Sequence
  Synthetic Construct
tgtctggcctcctgttccat

SEQ ID NO: 31530 - DNA, 23 bp, Artificial Sequence
  Synthetic Construct
gtgcctctgaagcaagagacttc

SEQ ID NO: 31531 - DNA, 25 bp, Artificial Sequence
  Synthetic Construct
ccccaaaaaggcttacacagttaaa

SEQ ID NO: 31532 - DNA, 25 bp, Artificial Sequence
  Synthetic Construct
ccagaacaggcattgacaaactatg

SEQ ID NO: 31533 - DNA, 25 bp, Artificial Sequence
  Synthetic Construct
gctgtagaccttatgcttcctgtat

SEQ ID NO: 31534 - DNA, 24 bp, Artificial Sequence
  Synthetic Construct
ccttcacacaacaggagaggcatt

SEQ ID NO: 31535 - DNA, 22 bp, Artificial Sequence
  Synthetic Construct
ctcctcagtgccagctatgtca

SEQ ID NO: 31536 - DNA, 27 bp, Artificial Sequence
  Synthetic Construct
gaaggatttgaacgcatttaggaggta

SEQ ID NO: 31537 - DNA, 23 bp, Artificial Sequence
  Synthetic Construct
gggatgttttagggactgtgcaa

SEQ ID NO: 31538 - DNA, 20 bp, Artificial Sequence
  Synthetic Construct
ggttggctgcattgctcaaa

SEQ ID NO: 31539 - DNA, 21 bp, Artificial Sequence
  Synthetic Construct
agggtggccctcatgatttct

SEQ ID NO: 31540 - DNA, 27 bp, Artificial Sequence
  Synthetic Construct
ctgctttgattgggaacagatggtcta

SEQ ID NO: 31541 - DNA, 24 bp, Artificial Sequence
  Synthetic Construct
gagagagaaggttgaggggtcaga

SEQ ID NO: 31542 - DNA, 24 bp, Artificial Sequence
  Synthetic Construct
ggggtagcctgtaaccagtgattg

SEQ ID NO: 31543 - DNA, 26 bp, Artificial Sequence
  Synthetic Construct
ctgcttttcttcctggagtctggaat

SEQ ID NO: 31544 - DNA, 22 bp, Artificial Sequence
  Synthetic Construct
tggtttgctccttttggtggtt

SEQ ID NO: 31545 - DNA, 26 bp, Artificial Sequence
  Synthetic Construct
ctcaaactgtagctgtcttggttttc

SEQ ID NO: 31546 - DNA, 23 bp, Artificial Sequence
  Synthetic Construct
gcccacaagtctcatccctctca

SEQ ID NO: 31547 - DNA, 21 bp, Artificial Sequence
  Synthetic Construct
gctctatgcccaggccagatt

SEQ ID NO: 31548 - DNA, 24 bp, Artificial Sequence
  Synthetic Construct
ggcaacagaatttgcttctggtaa

SEQ ID NO: 31549 - DNA, 25 bp, Artificial Sequence
  Synthetic Construct
ggagagtccaccaaaagataagtgt

SEQ ID NO: 31550 - DNA, 23 bp, Artificial Sequence
  Synthetic Construct
ggtttggcctatggttgggtctt

SEQ ID NO: 31551 - DNA, 27 bp, Artificial Sequence
  Synthetic Construct
ggatatgaaagttacaggacagcaatc

SEQ ID NO: 31552 - DNA, 24 bp, Artificial Sequence
  Synthetic Construct
tctggtgccttccataagactaga

SEQ ID NO: 31553 - DNA, 22 bp, Artificial Sequence
  Synthetic Construct
ggcttagcccacaagtgttctt

SEQ ID NO: 31554 - DNA, 23 bp, Artificial Sequence
  Synthetic Construct
tcctctccctcaattccaaccat

SEQ ID NO: 31555 - DNA, 21 bp, Artificial Sequence
  Synthetic Construct
ggtgctggtggctggaagtta

SEQ ID NO: 31556 - DNA, 20 bp, Artificial Sequence
  Synthetic Construct
ccatggaggtgggcttctca

SEQ ID NO: 31557 - DNA, 20 bp, Artificial Sequence
  Synthetic Construct
agacaggcaggccttgaact

SEQ ID NO: 31558 - DNA, 26 bp, Artificial Sequence
  Synthetic Construct
ggtgtaatctagcctaacttgactga

SEQ ID NO: 31559 - DNA, 25 bp, Artificial Sequence
  Synthetic Construct
ccaagctccaagatgacaagctcaa

SEQ ID NO: 31560 - DNA, 22 bp, Artificial Sequence
  Synthetic Construct
ggatctgtggctcaagctcagt

SEQ ID NO: 31561 - DNA, 25 bp, Artificial Sequence
  Synthetic Construct
aactacagcccaaagtgagaaaatg

SEQ ID NO: 31562 - DNA, 25 bp, Artificial Sequence
  Synthetic Construct
tcctaagggcatcactttgacttac

SEQ ID NO: 31563 - DNA, 20 bp, Artificial Sequence
  Synthetic Construct
tctctgctctgcccatgcta

SEQ ID NO: 31564 - DNA, 22 bp, Artificial Sequence
  Synthetic Construct
agcccttaggcagtagccttgt

SEQ ID NO: 31565 - DNA, 22 bp, Artificial Sequence
  Synthetic Construct
cctcatgcctggcccatttagt

SEQ ID NO: 31566 - DNA, 24 bp, Artificial Sequence
  Synthetic Construct
tgtaacatgcctctgtcatagcaa

SEQ ID NO: 31567 - DNA, 23 bp, Artificial Sequence
  Synthetic Construct
actggcttgaattcagggcttta

SEQ ID NO: 31568 - DNA, 25 bp, Artificial Sequence
  Synthetic Construct
tgctgtggtttatgaatccatgttc

SEQ ID NO: 31569 - DNA, 22 bp, Artificial Sequence
  Synthetic Construct
cttgcaccttccaacccctatc

SEQ ID NO: 31570 - DNA, 22 bp, Artificial Sequence
  Synthetic Construct
gggtcacagaggcagtgatgat

SEQ ID NO: 31571 - DNA, 24 bp, Artificial Sequence
  Synthetic Construct
tgagactggtaagctatggactct

SEQ ID NO: 31572 - DNA, 23 bp, Artificial Sequence
  Synthetic Construct
cctggctagtaggcacctaaaac

SEQ ID NO: 31573 - DNA, 20 bp, Artificial Sequence
  Synthetic Construct
tgtcccacagaggacagctt

SEQ ID NO: 31574 - DNA, 25 bp, Artificial Sequence
  Synthetic Construct
cctgactgattggtcatgtggtctt

SEQ ID NO: 31575 - DNA, 25 bp, Artificial Sequence
  Synthetic Construct
ggacccaccatagtcagaactaaga

SEQ ID NO: 31576 - DNA, 24 bp, Artificial Sequence
  Synthetic Construct
tggacagaatccagtttgatggaa

SEQ ID NO: 31577 - DNA, 24 bp, Artificial Sequence
  Synthetic Construct
gactggagcacaggttactttaca

SEQ ID NO: 31578 - DNA, 26 bp, Artificial Sequence
  Synthetic Construct
gtgcagacaagttcactgagtaattc

SEQ ID NO: 31579 - DNA, 25 bp, Artificial Sequence
  Synthetic Construct
ggatctgttgcagagctttcttttg

SEQ ID NO: 31580 - DNA, 25 bp, Artificial Sequence
  Synthetic Construct
ttacttccacttacattccgtgaca

SEQ ID NO: 31581 - DNA, 26 bp, Artificial Sequence
  Synthetic Construct
gagcaaactggtagccactaattctt

SEQ ID NO: 31582 - DNA, 30 bp, Artificial Sequence
  Synthetic Construct
ggaggagatctgaaataggaaagacagtca

SEQ ID NO: 31583 - DNA, 24 bp, Artificial Sequence
  Synthetic Construct
ggagaacttagggaagtccagttg

SEQ ID NO: 31584 - DNA, 20 bp, Artificial Sequence
  Synthetic Construct
gagcagtgacgcctccattt

SEQ ID NO: 31585 - DNA, 24 bp, Artificial Sequence
  Synthetic Construct
gggagctctgttttcactgtgtta

SEQ ID NO: 31586 - DNA, 22 bp, Artificial Sequence
  Synthetic Construct
cactgggacaagtagcatgaca

SEQ ID NO: 31587 - DNA, 25 bp, Artificial Sequence
  Synthetic Construct
cttctaatgcaggggtttttgtctt

SEQ ID NO: 31588 - DNA, 23 bp, Artificial Sequence
  Synthetic Construct
agtggggtaaaacctgtgtttct

SEQ ID NO: 31589 - DNA, 23 bp, Artificial Sequence
  Synthetic Construct
ggttgagagacaagccttagcat

SEQ ID NO: 31590 - DNA, 29 bp, Artificial Sequence
  Synthetic Construct
ctccattctcaactcattcaacctctaag

SEQ ID NO: 31591 - DNA, 25 bp, Artificial Sequence
  Synthetic Construct
ggcatccatctgtactcccagctat

SEQ ID NO: 31592 - DNA, 25 bp, Artificial Sequence
  Synthetic Construct
ggtgattgacacactgaggatccaa

SEQ ID NO: 31593 - DNA, 25 bp, Artificial Sequence
  Synthetic Construct
ccccaccaccccgatttaataatac

SEQ ID NO: 31594 - DNA, 24 bp, Artificial Sequence
  Synthetic Construct
ccaacacagggaaaggttaagtga

SEQ ID NO: 31595 - DNA, 24 bp, Artificial Sequence
  Synthetic Construct
gcaaacaggaacacctggttgtct

SEQ ID NO: 31596 - DNA, 25 bp, Artificial Sequence
  Synthetic Construct
gtctgttctcaaaccttccttctgt

SEQ ID NO: 31597 - DNA, 27 bp, Artificial Sequence
  Synthetic Construct
cacaacacaggctaagaaaacctaatg

SEQ ID NO: 31598 - DNA, 21 bp, Artificial Sequence
  Synthetic Construct
ggagttggcaggagcatcaga

SEQ ID NO: 31599 - DNA, 24 bp, Artificial Sequence
  Synthetic Construct
gggaccttttgaggcttgcagttc

SEQ ID NO: 31600 - DNA, 26 bp, Artificial Sequence
  Synthetic Construct
cagaggcaaatgaaatgagctgttag

SEQ ID NO: 31601 - DNA, 21 bp, Artificial Sequence
  Synthetic Construct
agcacaaagcacttggtcaga

SEQ ID NO: 31602 - DNA, 23 bp, Artificial Sequence
  Synthetic Construct
ccacagaccctgacccaatgatg

SEQ ID NO: 31603 - DNA, 25 bp, Artificial Sequence
  Synthetic Construct
ggaagttaactgggagaggcaatag

SEQ ID NO: 31604 - DNA, 26 bp, Artificial Sequence
  Synthetic Construct
gcccatgttgagataatggctacctt

SEQ ID NO: 31605 - DNA, 23 bp, Artificial Sequence
  Synthetic Construct
aggatggggaagctagaagtcaa

SEQ ID NO: 31606 - DNA, 22 bp, Artificial Sequence
  Synthetic Construct
cattgccttgaccccactaaga

SEQ ID NO: 31607 - DNA, 25 bp, Artificial Sequence
  Synthetic Construct
ggggaggcaatgaagaaaagcctaa

SEQ ID NO: 31608 - DNA, 22 bp, Artificial Sequence
  Synthetic Construct
tgcccaatgtccaatgtcttga

SEQ ID NO: 31609 - DNA, 22 bp, Artificial Sequence
  Synthetic Construct
gagtctgtcttcttgcctgtca

SEQ ID NO: 31610 - DNA, 23 bp, Artificial Sequence
  Synthetic Construct
tgaaaggcatgcaaacagtcttc

SEQ ID NO: 31611 - DNA, 25 bp, Artificial Sequence
  Synthetic Construct
ggtgggagcttctctttaacttttc

SEQ ID NO: 31612 - DNA, 25 bp, Artificial Sequence
  Synthetic Construct
gcttccaacgtccctatcttagtgt

SEQ ID NO: 31613 - DNA, 23 bp, Artificial Sequence
  Synthetic Construct
gccattgacatgtctggctgaag

SEQ ID NO: 31614 - DNA, 24 bp, Artificial Sequence
  Synthetic Construct
gcctttgactttggtgtgaaccta

SEQ ID NO: 31615 - DNA, 27 bp, Artificial Sequence
  Synthetic Construct
ctggtgagctattttccactggatatg

SEQ ID NO: 31616 - DNA, 23 bp, Artificial Sequence
  Synthetic Construct
tgaaaaagtggcctctagtgtgt

SEQ ID NO: 31617 - DNA, 25 bp, Artificial Sequence
  Synthetic Construct
gggagagagagttttgtgtctgttc

SEQ ID NO: 31618 - DNA, 21 bp, Artificial Sequence
  Synthetic Construct
ccactaccagcaggcaacctt

SEQ ID NO: 31619 - DNA, 24 bp, Artificial Sequence
  Synthetic Construct
cctggaataaactttgcccagaca

SEQ ID NO: 31620 - DNA, 27 bp, Artificial Sequence
  Synthetic Construct
ctcaatcctggagtacaatttctgtct

SEQ ID NO: 31621 - DNA, 23 bp, Artificial Sequence
  Synthetic Construct
aatctgctcctttcctggtcttc

SEQ ID NO: 31622 - DNA, 25 bp, Artificial Sequence
  Synthetic Construct
gacactcaaaaggctaagggctaac

SEQ ID NO: 31623 - DNA, 23 bp, Artificial Sequence
  Synthetic Construct
cacagtggacagcatgactcaga

SEQ ID NO: 31624 - DNA, 25 bp, Artificial Sequence
  Synthetic Construct
gaaatggtgctaacttgctctccaa

SEQ ID NO: 31625 - DNA, 21 bp, Artificial Sequence
  Synthetic Construct
ggctgcccctgtcaatgatga

SEQ ID NO: 31626 - DNA, 24 bp, Artificial Sequence
  Synthetic Construct
gggtcagctgcagattatgtcatt

SEQ ID NO: 31627 - DNA, 21 bp, Artificial Sequence
  Synthetic Construct
caagggagaaggtgggagaca

SEQ ID NO: 31628 - DNA, 22 bp, Artificial Sequence
  Synthetic Construct
agtccaaaaccgtgacaagaca

SEQ ID NO: 31629 - DNA, 20 bp, Artificial Sequence
  Synthetic Construct
accggactttgccagtcatc

SEQ ID NO: 31630 - DNA, 23 bp, Artificial Sequence
  Synthetic Construct
gacacttctggttgccacataca

SEQ ID NO: 31631 - DNA, 23 bp, Artificial Sequence
  Synthetic Construct
gtctcacacacagcccaaacgta

SEQ ID NO: 31632 - DNA, 22 bp, Artificial Sequence
  Synthetic Construct
gtggtcatttgccaaggctcta

SEQ ID NO: 31633 - DNA, 24 bp, Artificial Sequence
  Synthetic Construct
gtcacacccttcattctcccatct

SEQ ID NO: 31634 - DNA, 25 bp, Artificial Sequence
  Synthetic Construct
gtggtcaatgttaggggttcagtct

SEQ ID NO: 31635 - DNA, 21 bp, Artificial Sequence
  Synthetic Construct
tttgcagcgcagcctcagctt

SEQ ID NO: 31636 - DNA, 29 bp, Artificial Sequence
  Synthetic Construct
cctggttaaaggaagagtgagtctcagaa

SEQ ID NO: 31637 - DNA, 24 bp, Artificial Sequence
  Synthetic Construct
ggctaggaaaacccacattcaaca

SEQ ID NO: 31638 - DNA, 29 bp, Artificial Sequence
  Synthetic Construct
gcttaccaaataaagtcttcaccccttag

SEQ ID NO: 31639 - DNA, 25 bp, Artificial Sequence
  Synthetic Construct
cgaatgtcccactacttatggtgaa

SEQ ID NO: 31640 - DNA, 28 bp, Artificial Sequence
  Synthetic Construct
ccttgaatgatgctaatcctgagcgaaa

SEQ ID NO: 31641 - DNA, 27 bp, Artificial Sequence
  Synthetic Construct
ggtttttgtactggaggaaccaaaatg

SEQ ID NO: 31642 - DNA, 26 bp, Artificial Sequence
  Synthetic Construct
cctagcagtagcaattacaaccatct

SEQ ID NO: 31643 - DNA, 23 bp, Artificial Sequence
  Synthetic Construct
gagggaaaggagcactagacttc

SEQ ID NO: 31644 - DNA, 30 bp, Artificial Sequence
  Synthetic Construct
ctggagaaaggactacatagcagaattaga

SEQ ID NO: 31645 - DNA, 19 bp, Artificial Sequence
  Synthetic Construct
tgcaggcctggagcctgat

SEQ ID NO: 31646 - DNA, 21 bp, Artificial Sequence
  Synthetic Construct
gccttctgtgtcaaccagtgt

SEQ ID NO: 31647 - DNA, 25 bp, Artificial Sequence
  Synthetic Construct
agcagtgcaaaacagactaaggtat

SEQ ID NO: 31648 - DNA, 23 bp, Artificial Sequence
  Synthetic Construct
agatggtgtcttgaatgctgctt

SEQ ID NO: 31649 - DNA, 22 bp, Artificial Sequence
  Synthetic Construct
ggtgttgggtgtgtgggatcaa

SEQ ID NO: 31650 - DNA, 20 bp, Artificial Sequence
  Synthetic Construct
acgtggtcaaggccatgtgt

SEQ ID NO: 31651 - DNA, 21 bp, Artificial Sequence
  Synthetic Construct
gcttgtggccagggaaaggtt

SEQ ID NO: 31652 - DNA, 19 bp, Artificial Sequence
  Synthetic Construct
tcccctcaggcctggtgat

SEQ ID NO: 31653 - DNA, 24 bp, Artificial Sequence
  Synthetic Construct
gaccctaggtcttggatgacattt

SEQ ID NO: 31654 - DNA, 20 bp, Artificial Sequence
  Synthetic Construct
ctggcaggcaacagcaaatg

SEQ ID NO: 31655 - DNA, 23 bp, Artificial Sequence
  Synthetic Construct
agtggttggcagattgtctgaag

SEQ ID NO: 31656 - DNA, 23 bp, Artificial Sequence
  Synthetic Construct
ggttggtgagggacaaagtgtag

SEQ ID NO: 31657 - DNA, 21 bp, Artificial Sequence
  Synthetic Construct
ggaagccatttggggctcctt

SEQ ID NO: 31658 - DNA, 20 bp, Artificial Sequence
  Synthetic Construct
tgtcctgcctgggatgtgaa

SEQ ID NO: 31659 - DNA, 22 bp, Artificial Sequence
  Synthetic Construct
cacagggaggtcttgcacatca

SEQ ID NO: 31660 - DNA, 22 bp, Artificial Sequence
  Synthetic Construct
gggcaaccaacatccactcaga

SEQ ID NO: 31661 - DNA, 21 bp, Artificial Sequence
  Synthetic Construct
gctccatcattcagcgcttct

SEQ ID NO: 31662 - DNA, 24 bp, Artificial Sequence
  Synthetic Construct
ggcctcctctgggtaaaacctact

SEQ ID NO: 31663 - DNA, 23 bp, Artificial Sequence
  Synthetic Construct
ggtgttactggggaaaagctagt

SEQ ID NO: 31664 - DNA, 23 bp, Artificial Sequence
  Synthetic Construct
ggatctgagtccttgcaggtgat

SEQ ID NO: 31665 - DNA, 22 bp, Artificial Sequence
  Synthetic Construct
gtccgccatggttgaagtgatg

SEQ ID NO: 31666 - DNA, 24 bp, Artificial Sequence
  Synthetic Construct
ggctgctggttttaatggagatgt

SEQ ID NO: 31667 - DNA, 25 bp, Artificial Sequence
  Synthetic Construct
gtgtcctcaggccagactactctaa

SEQ ID NO: 31668 - DNA, 22 bp, Artificial Sequence
  Synthetic Construct
tccgctagtgcttcagtagtct

SEQ ID NO: 31669 - DNA, 27 bp, Artificial Sequence
  Synthetic Construct
ctggttctagtgtcttgaaaactgttg

SEQ ID NO: 31670 - DNA, 20 bp, Artificial Sequence
  Synthetic Construct
tcaacgggctgccttctctt

SEQ ID NO: 31671 - DNA, 22 bp, Artificial Sequence
  Synthetic Construct
gcaccatcgactttgcacattg

SEQ ID NO: 31672 - DNA, 25 bp, Artificial Sequence
  Synthetic Construct
gcaccctctagcatgctttttgtca

SEQ ID NO: 31673 - DNA, 27 bp, Artificial Sequence
  Synthetic Construct
gcagaagaaagcacaggatttgcatag

SEQ ID NO: 31674 - DNA, 23 bp, Artificial Sequence
  Synthetic Construct
cgggcctttaaggaaaccaggaa

SEQ ID NO: 31675 - DNA, 20 bp, Artificial Sequence
  Synthetic Construct
tggtggtgtggtgggtctat

SEQ ID NO: 31676 - DNA, 22 bp, Artificial Sequence
  Synthetic Construct
ccaccacaggctccttttcact

SEQ ID NO: 31677 - DNA, 23 bp, Artificial Sequence
  Synthetic Construct
gtccagaatcccaaactgtcaga

SEQ ID NO: 31678 - DNA, 23 bp, Artificial Sequence
  Synthetic Construct
ggaggagctgcatccatcttttg

SEQ ID NO: 31679 - DNA, 29 bp, Artificial Sequence
  Synthetic Construct
ccctcctgaaaaataatgcttaccccatt

SEQ ID NO: 31680 - DNA, 19 bp, Artificial Sequence
  Synthetic Construct
ccacagccctgtcgcatgt

SEQ ID NO: 31681 - DNA, 21 bp, Artificial Sequence
  Synthetic Construct
tggtgtggtgcttggctcttc

SEQ ID NO: 31682 - DNA, 25 bp, Artificial Sequence
  Synthetic Construct
cccctgcccaagtattttaaagcaa

SEQ ID NO: 31683 - DNA, 25 bp, Artificial Sequence
  Synthetic Construct
ccattgctctcttcagatccagtag

SEQ ID NO: 31684 - DNA, 26 bp, Artificial Sequence
  Synthetic Construct
caggttgcccattacagctattttga

SEQ ID NO: 31685 - DNA, 22 bp, Artificial Sequence
  Synthetic Construct
ccagtcacaagtgagccttctt

SEQ ID NO: 31686 - DNA, 23 bp, Artificial Sequence
  Synthetic Construct
acacgtgtcagtcacatcacata

SEQ ID NO: 31687 - DNA, 25 bp, Artificial Sequence
  Synthetic Construct
gcagtacccatgattgcttttcaag

SEQ ID NO: 31688 - DNA, 23 bp, Artificial Sequence
  Synthetic Construct
tgaagctggggacactgaatttg

SEQ ID NO: 31689 - DNA, 23 bp, Artificial Sequence
  Synthetic Construct
gcaaaagtaggccagtcaagaca

SEQ ID NO: 31690 - DNA, 20 bp, Artificial Sequence
  Synthetic Construct
tgccaggccatcttgccttt

SEQ ID NO: 31691 - DNA, 23 bp, Artificial Sequence
  Synthetic Construct
gatgtgcagcctaggaaagaaga

SEQ ID NO: 31692 - DNA, 19 bp, Artificial Sequence
  Synthetic Construct
cccagacccctgctccaaa

SEQ ID NO: 31693 - DNA, 22 bp, Artificial Sequence
  Synthetic Construct
cgaaaggtaggctaggccacaa

SEQ ID NO: 31694 - DNA, 27 bp, Artificial Sequence
  Synthetic Construct
gacaagtatttagctgtagggaagaga

SEQ ID NO: 31695 - DNA, 21 bp, Artificial Sequence
  Synthetic Construct
ggggtgcatctgtgtctgtgt

SEQ ID NO: 31696 - DNA, 29 bp, Artificial Sequence
  Synthetic Construct
ggaccaaaaatctgttaggtactcaggaa

SEQ ID NO: 31697 - DNA, 27 bp, Artificial Sequence
  Synthetic Construct
gatctgaattgaaatcccagctctttc

SEQ ID NO: 31698 - DNA, 30 bp, Artificial Sequence
  Synthetic Construct
ggacaccaaattttaggtcagcatttgact

SEQ ID NO: 31699 - DNA, 20 bp, Artificial Sequence
  Synthetic Construct
agctagctgtgtgggtgttg

SEQ ID NO: 31700 - DNA, 20 bp, Artificial Sequence
  Synthetic Construct
gggtccaacatgctgtccaa

SEQ ID NO: 31701 - DNA, 28 bp, Artificial Sequence
  Synthetic Construct
ctgcaaacatagtcggaggtataagaag

SEQ ID NO: 31702 - DNA, 22 bp, Artificial Sequence
  Synthetic Construct
gggtaccgtgattgcctccatt

SEQ ID NO: 31703 - DNA, 23 bp, Artificial Sequence
  Synthetic Construct
ccctccatcataaggtgagcttt

SEQ ID NO: 31704 - DNA, 22 bp, Artificial Sequence
  Synthetic Construct
gccaccagcactatggatgcaa

SEQ ID NO: 31705 - DNA, 22 bp, Artificial Sequence
  Synthetic Construct
cgctcatggtcacagtggtaca

SEQ ID NO: 31706 - DNA, 24 bp, Artificial Sequence
  Synthetic Construct
caccagtaagacactccctgagat

SEQ ID NO: 31707 - DNA, 24 bp, Artificial Sequence
  Synthetic Construct
catccttgcttcctgttagagact

SEQ ID NO: 31708 - DNA, 21 bp, Artificial Sequence
  Synthetic Construct
aaggtgagcaggggcagaact

SEQ ID NO: 31709 - DNA, 23 bp, Artificial Sequence
  Synthetic Construct
gagtagctgcgtatcagtaccaa

SEQ ID NO: 31710 - DNA, 21 bp, Artificial Sequence
  Synthetic Construct
cgcgcccggtcatgagataaa

SEQ ID NO: 31711 - DNA, 22 bp, Artificial Sequence
  Synthetic Construct
tccaaaccactaccacccaaga

SEQ ID NO: 31712 - DNA, 23 bp, Artificial Sequence
  Synthetic Construct
ggcacacgagcattctgtctgta

SEQ ID NO: 31713 - DNA, 24 bp, Artificial Sequence
  Synthetic Construct
gccattgtctgcctcagaagtgtt

SEQ ID NO: 31714 - DNA, 22 bp, Artificial Sequence
  Synthetic Construct
gcactagagcagggctttcttc

SEQ ID NO: 31715 - DNA, 27 bp, Artificial Sequence
  Synthetic Construct
ggggtatacaaaggtagtgaggcatga

SEQ ID NO: 31716 - DNA, 22 bp, Artificial Sequence
  Synthetic Construct
ccagcccaacaaagcccagatt

SEQ ID NO: 31717 - DNA, 24 bp, Artificial Sequence
  Synthetic Construct
ctcacccttgatcagctcccattc

SEQ ID NO: 31718 - DNA, 24 bp, Artificial Sequence
  Synthetic Construct
gccactggaactcagaagagtcaa

SEQ ID NO: 31719 - DNA, 23 bp, Artificial Sequence
  Synthetic Construct
ctctggttcctcctgcaaccatt

SEQ ID NO: 31720 - DNA, 25 bp, Artificial Sequence
  Synthetic Construct
gtggttatccagagaaggtggaaca

SEQ ID NO: 31721 - DNA, 20 bp, Artificial Sequence
  Synthetic Construct
cccagctccagtggatgaag

SEQ ID NO: 31722 - DNA, 21 bp, Artificial Sequence
  Synthetic Construct
cctgcccttgtccacaatgtt

SEQ ID NO: 31723 - DNA, 24 bp, Artificial Sequence
  Synthetic Construct
gcactggctaggacttccagtatg

SEQ ID NO: 31724 - DNA, 23 bp, Artificial Sequence
  Synthetic Construct
tttcccgctatatctgtgcaagt

SEQ ID NO: 31725 - DNA, 25 bp, Artificial Sequence
  Synthetic Construct
ggaagaaggcatcccatttgaaaca

SEQ ID NO: 31726 - DNA, 24 bp, Artificial Sequence
  Synthetic Construct
cacccaggtcccaatataacatga

SEQ ID NO: 31727 - DNA, 25 bp, Artificial Sequence
  Synthetic Construct
caagataagtgccatggttgtctca

SEQ ID NO: 31728 - DNA, 24 bp, Artificial Sequence
  Synthetic Construct
agttggcacagagaaaagtgtttg

SEQ ID NO: 31729 - DNA, 25 bp, Artificial Sequence
  Synthetic Construct
gtctgtgcagaataaagcccaaact

SEQ ID NO: 31730 - DNA, 20 bp, Artificial Sequence
  Synthetic Construct
accaggcaggctttgctgaa

SEQ ID NO: 31731 - DNA, 21 bp, Artificial Sequence
  Synthetic Construct
tcatcctcccaacctgactgt

SEQ ID NO: 31732 - DNA, 24 bp, Artificial Sequence
  Synthetic Construct
tgtcagaaccttgttgagttgtga

SEQ ID NO: 31733 - DNA, 27 bp, Artificial Sequence
  Synthetic Construct
gactcaaccatctgctgcctaaaatag

SEQ ID NO: 31734 - DNA, 24 bp, Artificial Sequence
  Synthetic Construct
tgctggggagttaaaggaaattgt

SEQ ID NO: 31735 - DNA, 23 bp, Artificial Sequence
  Synthetic Construct
caggaccacaattgatgccattt

SEQ ID NO: 31736 - DNA, 26 bp, Artificial Sequence
  Synthetic Construct
agtaggagacagagggtttctatcat

SEQ ID NO: 31737 - DNA, 23 bp, Artificial Sequence
  Synthetic Construct
aacttggtgtctttgtggggtta

SEQ ID NO: 31738 - DNA, 22 bp, Artificial Sequence
  Synthetic Construct
ggggtggcaataggagcacttt

SEQ ID NO: 31739 - DNA, 20 bp, Artificial Sequence
  Synthetic Construct
catgccaagctgtgctgact

SEQ ID NO: 31740 - DNA, 20 bp, Artificial Sequence
  Synthetic Construct
tgcgtgagtgggtgcagaat

SEQ ID NO: 31741 - DNA, 26 bp, Artificial Sequence
  Synthetic Construct
cttctactgaactcctggaaggagaa

SEQ ID NO: 31742 - DNA, 22 bp, Artificial Sequence
  Synthetic Construct
gcagtccattttccacccaatc

SEQ ID NO: 31743 - DNA, 24 bp, Artificial Sequence
  Synthetic Construct
ggaccaggaaaggaaggtgcatag

SEQ ID NO: 31744 - DNA, 25 bp, Artificial Sequence
  Synthetic Construct
acatttgggatggacattcagaaca

SEQ ID NO: 31745 - DNA, 25 bp, Artificial Sequence
  Synthetic Construct
gggaagggaatcttaggcagaggaa

SEQ ID NO: 31746 - DNA, 24 bp, Artificial Sequence
  Synthetic Construct
ccccagtggaagagagatatccaa

SEQ ID NO: 31747 - DNA, 25 bp, Artificial Sequence
  Synthetic Construct
tgaactttaggctgcctttatggaa

SEQ ID NO: 31748 - DNA, 23 bp, Artificial Sequence
  Synthetic Construct
gtgggctcagggaatcatactac

SEQ ID NO: 31749 - DNA, 22 bp, Artificial Sequence
  Synthetic Construct
tcaaggcaatgggtttccttct

SEQ ID NO: 31750 - DNA, 22 bp, Artificial Sequence
  Synthetic Construct
gggcagaggttatgggtacctt

SEQ ID NO: 31751 - DNA, 20 bp, Artificial Sequence
  Synthetic Construct
agccaggtctgggagacaac

SEQ ID NO: 31752 - DNA, 19 bp, Artificial Sequence
  Synthetic Construct
cacggtgaggccattcact

SEQ ID NO: 31753 - DNA, 20 bp, Artificial Sequence
  Synthetic Construct
aggccaagatcagcctcctt

SEQ ID NO: 31754 - DNA, 21 bp, Artificial Sequence
  Synthetic Construct
tcgaccccaggtccatcaact

SEQ ID NO: 31755 - DNA, 23 bp, Artificial Sequence
  Synthetic Construct
gacgcaaaccaaatcccaactgt

SEQ ID NO: 31756 - DNA, 24 bp, Artificial Sequence
  Synthetic Construct
tccctgacaactccttctaagact

SEQ ID NO: 31757 - DNA, 23 bp, Artificial Sequence
  Synthetic Construct
ctgccacttacctagggtcagaa

SEQ ID NO: 31758 - DNA, 19 bp, Artificial Sequence
  Synthetic Construct
gcccttgcctgtgggcttt

SEQ ID NO: 31759 - DNA, 23 bp, Artificial Sequence
  Synthetic Construct
gccactgctgatctcatcccatt

SEQ ID NO: 31760 - DNA, 26 bp, Artificial Sequence
  Synthetic Construct
gactcacatctattcccttggttact

SEQ ID NO: 31761 - DNA, 26 bp, Artificial Sequence
  Synthetic Construct
gagatgggacctagataaagcagaag

SEQ ID NO: 31762 - DNA, 24 bp, Artificial Sequence
  Synthetic Construct
ggccaacatctgggattgtgatac

SEQ ID NO: 31763 - DNA, 22 bp, Artificial Sequence
  Synthetic Construct
ggacttgtgtttgctgtggttt

SEQ ID NO: 31764 - DNA, 21 bp, Artificial Sequence
  Synthetic Construct
gctcttgcggactggtgcata

SEQ ID NO: 31765 - DNA, 19 bp, Artificial Sequence
  Synthetic Construct
tgaactcctggggccaagt

SEQ ID NO: 31766 - DNA, 23 bp, Artificial Sequence
  Synthetic Construct
gatccccttgctcagttagtgaa

SEQ ID NO: 31767 - DNA, 25 bp, Artificial Sequence
  Synthetic Construct
gcactgtaactgcgaaaaccatctt

SEQ ID NO: 31768 - DNA, 25 bp, Artificial Sequence
  Synthetic Construct
agattcagcctaacagtcagtcaat

SEQ ID NO: 31769 - DNA, 22 bp, Artificial Sequence
  Synthetic Construct
agtgaccactgagactgacact

SEQ ID NO: 31770 - DNA, 28 bp, Artificial Sequence
  Synthetic Construct
cctgataagttaagaatgggtccctgat

SEQ ID NO: 31771 - DNA, 24 bp, Artificial Sequence
  Synthetic Construct
ccgactctgacacctgactcctat

SEQ ID NO: 31772 - DNA, 25 bp, Artificial Sequence
  Synthetic Construct
cccctgaaaagcttgtccaataaca

SEQ ID NO: 31773 - DNA, 24 bp, Artificial Sequence
  Synthetic Construct
gccaagctgacttgttggtactgt

SEQ ID NO: 31774 - DNA, 22 bp, Artificial Sequence
  Synthetic Construct
tgacctccagggctgaagtgat

SEQ ID NO: 31775 - DNA, 25 bp, Artificial Sequence
  Synthetic Construct
gctctgcacttttcagtggaggata

SEQ ID NO: 31776 - DNA, 24 bp, Artificial Sequence
  Synthetic Construct
gggttccttttcagcatcatttgt

SEQ ID NO: 31777 - DNA, 23 bp, Artificial Sequence
  Synthetic Construct
tcttcctcagctcagtccttaca

SEQ ID NO: 31778 - DNA, 24 bp, Artificial Sequence
  Synthetic Construct
gactgcaataccccttccaatttc

SEQ ID NO: 31779 - DNA, 21 bp, Artificial Sequence
  Synthetic Construct
ccttgccgggaaacagacaga

SEQ ID NO: 31780 - DNA, 25 bp, Artificial Sequence
  Synthetic Construct
ccagaaacacagcttgttggacaaa

SEQ ID NO: 31781 - DNA, 30 bp, Artificial Sequence
  Synthetic Construct
cacatcctaattcactccagactatggaaa

SEQ ID NO: 31782 - DNA, 28 bp, Artificial Sequence
  Synthetic Construct
cagaaaactggctatggggaaattccta

SEQ ID NO: 31783 - DNA, 22 bp, Artificial Sequence
  Synthetic Construct
cagcttcagattcgggcaggtt

SEQ ID NO: 31784 - DNA, 23 bp, Artificial Sequence
  Synthetic Construct
gctagaggggaggagttctgaag

SEQ ID NO: 31785 - DNA, 23 bp, Artificial Sequence
  Synthetic Construct
ctagccagctatgctcctgttac

SEQ ID NO: 31786 - DNA, 20 bp, Artificial Sequence
  Synthetic Construct
ggggtgcagcggcataatca

SEQ ID NO: 31787 - DNA, 24 bp, Artificial Sequence
  Synthetic Construct
cctaaagccacgtgatctttgaca

SEQ ID NO: 31788 - DNA, 22 bp, Artificial Sequence
  Synthetic Construct
gcctatttcccttgcactgtga

SEQ ID NO: 31789 - DNA, 24 bp, Artificial Sequence
  Synthetic Construct
gaccagtaggactccagtggaaga

SEQ ID NO: 31790 - DNA, 24 bp, Artificial Sequence
  Synthetic Construct
ccaaagcagaccgactctcctaca

SEQ ID NO: 31791 - DNA, 23 bp, Artificial Sequence
  Synthetic Construct
gtgcacacatcacacatccttgt

SEQ ID NO: 31792 - DNA, 26 bp, Artificial Sequence
  Synthetic Construct
ggccaactacaagtccctagctcttt

SEQ ID NO: 31793 - DNA, 20 bp, Artificial Sequence
  Synthetic Construct
acggtggaggtgggtgtaga

SEQ ID NO: 31794 - DNA, 25 bp, Artificial Sequence
  Synthetic Construct
gggtcaaactgtaggctagaccaat

SEQ ID NO: 31795 - DNA, 25 bp, Artificial Sequence
  Synthetic Construct
tggcaaagacactttatcacaggtt

SEQ ID NO: 31796 - DNA, 26 bp, Artificial Sequence
  Synthetic Construct
gggtgttaaaaagtgctttgctccaa

SEQ ID NO: 31797 - DNA, 24 bp, Artificial Sequence
  Synthetic Construct
agccaaacctgactccatcaattt

SEQ ID NO: 31798 - DNA, 24 bp, Artificial Sequence
  Synthetic Construct
tgtctcctggtagttcttggtagt

SEQ ID NO: 31799 - DNA, 22 bp, Artificial Sequence
  Synthetic Construct
cagcgtcactggatgggtaatg

SEQ ID NO: 31800 - DNA, 24 bp, Artificial Sequence
  Synthetic Construct
caacctgataaagggcaaccacaa

SEQ ID NO: 31801 - DNA, 22 bp, Artificial Sequence
  Synthetic Construct
ggctgcaccttcacaaatggat

SEQ ID NO: 31802 - DNA, 20 bp, Artificial Sequence
  Synthetic Construct
tggctggaggtgaacagttg

SEQ ID NO: 31803 - DNA, 20 bp, Artificial Sequence
  Synthetic Construct
tccaagcccgcagttcttca

SEQ ID NO: 31804 - DNA, 21 bp, Artificial Sequence
  Synthetic Construct
aaattgttggctcgcctctct

SEQ ID NO: 31805 - DNA, 26 bp, Artificial Sequence
  Synthetic Construct
caccagttcccatggaaaaccataag

SEQ ID NO: 31806 - DNA, 30 bp, Artificial Sequence
  Synthetic Construct
cctatttgcttccatcctcctagtagattt

SEQ ID NO: 31807 - DNA, 23 bp, Artificial Sequence
  Synthetic Construct
gcgttttggtaacccagacaaag

SEQ ID NO: 31808 - DNA, 22 bp, Artificial Sequence
  Synthetic Construct
tgcctcatgcctggactaattt

SEQ ID NO: 31809 - DNA, 26 bp, Artificial Sequence
  Synthetic Construct
cgaaggtaagactctggcaagtgaag

SEQ ID NO: 31810 - DNA, 22 bp, Artificial Sequence
  Synthetic Construct
ggagcagcctcaaggaccttat

SEQ ID NO: 31811 - DNA, 26 bp, Artificial Sequence
  Synthetic Construct
gcagctgttatatgtacctctgtact

SEQ ID NO: 31812 - DNA, 23 bp, Artificial Sequence
  Synthetic Construct
aaggacagggtagcaaagtgtag

SEQ ID NO: 31813 - DNA, 22 bp, Artificial Sequence
  Synthetic Construct
tgtctgtaacccaggagtctca

SEQ ID NO: 31814 - DNA, 25 bp, Artificial Sequence
  Synthetic Construct
tgggatattggcctgaagttttctt

SEQ ID NO: 31815 - DNA, 23 bp, Artificial Sequence
  Synthetic Construct
aggcatcaaatacctctgtgctt

SEQ ID NO: 31816 - DNA, 24 bp, Artificial Sequence
  Synthetic Construct
caccatagcagtagtgctggtcta

SEQ ID NO: 31817 - DNA, 25 bp, Artificial Sequence
  Synthetic Construct
gcctcattgcaccttttctcctgta

SEQ ID NO: 31818 - DNA, 23 bp, Artificial Sequence
  Synthetic Construct
gggcaaggagaggggtgttttta

SEQ ID NO: 31819 - DNA, 24 bp, Artificial Sequence
  Synthetic Construct
gcagcctctgtaacagggtttgat

SEQ ID NO: 31820 - DNA, 25 bp, Artificial Sequence
  Synthetic Construct
ggcttcctttactggacctactttc

SEQ ID NO: 31821 - DNA, 22 bp, Artificial Sequence
  Synthetic Construct
cccactggttctggctctttgt

SEQ ID NO: 31822 - DNA, 26 bp, Artificial Sequence
  Synthetic Construct
ctcagcttaaaaaccagtgtcctaga

SEQ ID NO: 31823 - DNA, 25 bp, Artificial Sequence
  Synthetic Construct
cagagaggagcaggacattccatac

SEQ ID NO: 31824 - DNA, 22 bp, Artificial Sequence
  Synthetic Construct
ggccaaggcaccttctcattgt

SEQ ID NO: 31825 - DNA, 19 bp, Artificial Sequence
  Synthetic Construct
aggttccaggctgcagtga

SEQ ID NO: 31826 - DNA, 19 bp, Artificial Sequence
  Synthetic Construct
gctctgcgttcccggaagt

SEQ ID NO: 31827 - DNA, 26 bp, Artificial Sequence
  Synthetic Construct
cattctgaaagtagggagggactaag

SEQ ID NO: 31828 - DNA, 22 bp, Artificial Sequence
  Synthetic Construct
caccttcccaaatggaggacat

SEQ ID NO: 31829 - DNA, 22 bp, Artificial Sequence
  Synthetic Construct
tcaggccctaggttcagtctgt

SEQ ID NO: 31830 - DNA, 23 bp, Artificial Sequence
  Synthetic Construct
ggggtctgctctagggaacaatc

SEQ ID NO: 31831 - DNA, 25 bp, Artificial Sequence
  Synthetic Construct
agaacagaactcactggaatgacaa

SEQ ID NO: 31832 - DNA, 27 bp, Artificial Sequence
  Synthetic Construct
ctgactgtatgtgactgactggaattg

SEQ ID NO: 31833 - DNA, 23 bp, Artificial Sequence
  Synthetic Construct
catcgaagtggcaggaaatgaag

SEQ ID NO: 31834 - DNA, 24 bp, Artificial Sequence
  Synthetic Construct
gacaagtccagctcagagaatgaa

SEQ ID NO: 31835 - DNA, 25 bp, Artificial Sequence
  Synthetic Construct
ccttgactgacaggtaactcacaaa

SEQ ID NO: 31836 - DNA, 23 bp, Artificial Sequence
  Synthetic Construct
tctgaagaacaggctcagtgttg

SEQ ID NO: 31837 - DNA, 25 bp, Artificial Sequence
  Synthetic Construct
ttctccaaagaggattctgctctac

SEQ ID NO: 31838 - DNA, 24 bp, Artificial Sequence
  Synthetic Construct
gagctgagcactggatgagactta

SEQ ID NO: 31839 - DNA, 26 bp, Artificial Sequence
  Synthetic Construct
gccgattgagcaagtgagttctccta

SEQ ID NO: 31840 - DNA, 22 bp, Artificial Sequence
  Synthetic Construct
ggacttttcccagggcctcaaa

SEQ ID NO: 31841 - DNA, 21 bp, Artificial Sequence
  Synthetic Construct
gactgcaggggtttcacttgt

SEQ ID NO: 31842 - DNA, 22 bp, Artificial Sequence
  Synthetic Construct
gtcatcccatgtggcctgtagt

SEQ ID NO: 31843 - DNA, 21 bp, Artificial Sequence
  Synthetic Construct
ggatgtcacttgtgggcaact

SEQ ID NO: 31844 - DNA, 20 bp, Artificial Sequence
  Synthetic Construct
gaacgcggctcactcatttg

SEQ ID NO: 31845 - DNA, 20 bp, Artificial Sequence
  Synthetic Construct
ggcgccagtgctttatgtct

SEQ ID NO: 31846 - DNA, 28 bp, Artificial Sequence
  Synthetic Construct
ggaggattctcatcttcctggtatcatc

SEQ ID NO: 31847 - DNA, 21 bp, Artificial Sequence
  Synthetic Construct
aggggtggtctcctcccttat

SEQ ID NO: 31848 - DNA, 19 bp, Artificial Sequence
  Synthetic Construct
tgtgcagtgggcaggaaga

SEQ ID NO: 31849 - DNA, 26 bp, Artificial Sequence
  Synthetic Construct
caaacaaccataggtcctttctctca

SEQ ID NO: 31850 - DNA, 28 bp, Artificial Sequence
  Synthetic Construct
ggtctcttagtttagaggtcacttcgtt

SEQ ID NO: 31851 - DNA, 22 bp, Artificial Sequence
  Synthetic Construct
ttgaggaggggagaggcaaaag

SEQ ID NO: 31852 - DNA, 27 bp, Artificial Sequence
  Synthetic Construct
gcaaacacagtgtaaggtagtaagaac

SEQ ID NO: 31853 - DNA, 26 bp, Artificial Sequence
  Synthetic Construct
ctttctccagcaagctctctttttac

SEQ ID NO: 31854 - DNA, 20 bp, Artificial Sequence
  Synthetic Construct
gctggcaggactcatgtgat

SEQ ID NO: 31855 - DNA, 23 bp, Artificial Sequence
  Synthetic Construct
ccaggatggccaacacattcttc

SEQ ID NO: 31856 - DNA, 20 bp, Artificial Sequence
  Synthetic Construct
cagccgtactgcctttcaca

SEQ ID NO: 31857 - DNA, 22 bp, Artificial Sequence
  Synthetic Construct
gcagaccctgagatggagattg

SEQ ID NO: 31858 - DNA, 23 bp, Artificial Sequence
  Synthetic Construct
ctgcttgctcagggttgtgaaaa

SEQ ID NO: 31859 - DNA, 22 bp, Artificial Sequence
  Synthetic Construct
ctccaagccggctcctttacat

SEQ ID NO: 31860 - DNA, 26 bp, Artificial Sequence
  Synthetic Construct
gtttggagctctccctgaacaataaa

SEQ ID NO: 31861 - DNA, 25 bp, Artificial Sequence
  Synthetic Construct
tgacttcaagtgaattgtggagctt

SEQ ID NO: 31862 - DNA, 22 bp, Artificial Sequence
  Synthetic Construct
ggcccagtgtcgagtttgtcta

SEQ ID NO: 31863 - DNA, 21 bp, Artificial Sequence
  Synthetic Construct
gttcacgtggctgagacaaac

SEQ ID NO: 31864 - DNA, 26 bp, Artificial Sequence
  Synthetic Construct
ggcatacaggaagggaaaggatgaca

SEQ ID NO: 31865 - DNA, 18 bp, Artificial Sequence
  Synthetic Construct
tgcgggatgcagagcaaa

SEQ ID NO: 31866 - DNA, 22 bp, Artificial Sequence
  Synthetic Construct
gagactgaaaagcctccagaca

SEQ ID NO: 31867 - DNA, 24 bp, Artificial Sequence
  Synthetic Construct
gtcattgtgggaagtgcatttgtt

SEQ ID NO: 31868 - DNA, 25 bp, Artificial Sequence
  Synthetic Construct
ccaggacacctatttcgtacccatt

SEQ ID NO: 31869 - DNA, 24 bp, Artificial Sequence
  Synthetic Construct
gacggtgattgtgatctgctacta

SEQ ID NO: 31870 - DNA, 23 bp, Artificial Sequence
  Synthetic Construct
ctgcaccatcttaaccccacttc

SEQ ID NO: 31871 - DNA, 23 bp, Artificial Sequence
  Synthetic Construct
gggcctaacaatccaccaaaaca

SEQ ID NO: 31872 - DNA, 25 bp, Artificial Sequence
  Synthetic Construct
ccagctttctatgacattgggctat

SEQ ID NO: 31873 - DNA, 24 bp, Artificial Sequence
  Synthetic Construct
ccagttactaccctgcgcttaatg

SEQ ID NO: 31874 - DNA, 24 bp, Artificial Sequence
  Synthetic Construct
tggagatggctgtcttctcatttt

SEQ ID NO: 31875 - DNA, 25 bp, Artificial Sequence
  Synthetic Construct
gcacaggatggacatcaggttcact

SEQ ID NO: 31876 - DNA, 19 bp, Artificial Sequence
  Synthetic Construct
cccaggctctgtgctttga

SEQ ID NO: 31877 - DNA, 22 bp, Artificial Sequence
  Synthetic Construct
gtgcacagccagaatcatcctt

SEQ ID NO: 31878 - DNA, 22 bp, Artificial Sequence
  Synthetic Construct
gcagcctggtggactattggat

SEQ ID NO: 31879 - DNA, 19 bp, Artificial Sequence
  Synthetic Construct
gcccctgcctgcatctcta

SEQ ID NO: 31880 - DNA, 24 bp, Artificial Sequence
  Synthetic Construct
ggaggggactcagggacctaaaat

SEQ ID NO: 31881 - DNA, 27 bp, Artificial Sequence
  Synthetic Construct
agtcagtagggttgcagaaagtataac

SEQ ID NO: 31882 - DNA, 22 bp, Artificial Sequence
  Synthetic Construct
ggcctctgtcccttctctttac

SEQ ID NO: 31883 - DNA, 22 bp, Artificial Sequence
  Synthetic Construct
ctccctgcaacaccctcttatc

SEQ ID NO: 31884 - DNA, 25 bp, Artificial Sequence
  Synthetic Construct
caaggtggtaacctgtgatttggtt

SEQ ID NO: 31885 - DNA, 27 bp, Artificial Sequence
  Synthetic Construct
ggaggaataatgtttgcaccagggaat

SEQ ID NO: 31886 - DNA, 21 bp, Artificial Sequence
  Synthetic Construct
ggcccctccctctttacaact

SEQ ID NO: 31887 - DNA, 19 bp, Artificial Sequence
  Synthetic Construct
ccgggttcgggtcaccttt

SEQ ID NO: 31888 - DNA, 22 bp, Artificial Sequence
  Synthetic Construct
aagaagacccacccctcagaga

SEQ ID NO: 31889 - DNA, 20 bp, Artificial Sequence
  Synthetic Construct
agtggggcctgtcctcaagt

SEQ ID NO: 31890 - DNA, 20 bp, Artificial Sequence
  Synthetic Construct
aaggacggcgcagtgaggaa

SEQ ID NO: 31891 - DNA, 22 bp, Artificial Sequence
  Synthetic Construct
ggtcactccctcatcagcttag

SEQ ID NO: 31892 - DNA, 25 bp, Artificial Sequence
  Synthetic Construct
ccctgagcctagggtattgtaattt

SEQ ID NO: 31893 - DNA, 21 bp, Artificial Sequence
  Synthetic Construct
ggtgcaactgatggctgtagt

SEQ ID NO: 31894 - DNA, 25 bp, Artificial Sequence
  Synthetic Construct
gaggaagtttgagcacactgggtta

SEQ ID NO: 31895 - DNA, 27 bp, Artificial Sequence
  Synthetic Construct
cttggttctgaagttttcaggtcaatc

SEQ ID NO: 31896 - DNA, 25 bp, Artificial Sequence
  Synthetic Construct
ccccataagctcccacttagtgtat

SEQ ID NO: 31897 - DNA, 23 bp, Artificial Sequence
  Synthetic Construct
ctgcccagtgctgtatcacacat

SEQ ID NO: 31898 - DNA, 24 bp, Artificial Sequence
  Synthetic Construct
gtccgtccaaacaaaaggttgact

SEQ ID NO: 31899 - DNA, 25 bp, Artificial Sequence
  Synthetic Construct
acacaaaagacttggacttccttct

SEQ ID NO: 31900 - DNA, 30 bp, Artificial Sequence
  Synthetic Construct
ggctcttctacataatactcttctctcatc

SEQ ID NO: 31901 - DNA, 20 bp, Artificial Sequence
  Synthetic Construct
tccgggccactggggtaaat

SEQ ID NO: 31902 - DNA, 26 bp, Artificial Sequence
  Synthetic Construct
ctagggaccaaattgcagtagaaatc

SEQ ID NO: 31903 - DNA, 22 bp, Artificial Sequence
  Synthetic Construct
gcaaaaggtgatccaggtctct

SEQ ID NO: 31904 - DNA, 20 bp, Artificial Sequence
  Synthetic Construct
agtggggagacaccaggaaa

SEQ ID NO: 31905 - DNA, 21 bp, Artificial Sequence
  Synthetic Construct
ttcccaggactgagctcttca

SEQ ID NO: 31906 - DNA, 26 bp, Artificial Sequence
  Synthetic Construct
gagaatgacttcctgcacaattggtt

SEQ ID NO: 31907 - DNA, 21 bp, Artificial Sequence
  Synthetic Construct
tggcttggaggagaccaggta

SEQ ID NO: 31908 - DNA, 26 bp, Artificial Sequence
  Synthetic Construct
gcctgtgtaaactgatcttggacttg

SEQ ID NO: 31909 - DNA, 23 bp, Artificial Sequence
  Synthetic Construct
ggaggcccagaatgccattttca

SEQ ID NO: 31910 - DNA, 22 bp, Artificial Sequence
  Synthetic Construct
gcactgaaagccttggaactga

SEQ ID NO: 31911 - DNA, 26 bp, Artificial Sequence
  Synthetic Construct
cctggctttcctcctttgacatacaa

SEQ ID NO: 31912 - DNA, 22 bp, Artificial Sequence
  Synthetic Construct
accctcaccatcctcagttgat

SEQ ID NO: 31913 - DNA, 24 bp, Artificial Sequence
  Synthetic Construct
tccttaaatgcctgaagccaaaag

SEQ ID NO: 31914 - DNA, 24 bp, Artificial Sequence
  Synthetic Construct
ccacatgtagctgctttgcaatta

SEQ ID NO: 31915 - DNA, 25 bp, Artificial Sequence
  Synthetic Construct
tccttctgaaatccttccattggtt

SEQ ID NO: 31916 - DNA, 25 bp, Artificial Sequence
  Synthetic Construct
gtcttctacccagttccttctcact

SEQ ID NO: 31917 - DNA, 20 bp, Artificial Sequence
  Synthetic Construct
aagccttgtgcctggagagt

SEQ ID NO: 31918 - DNA, 23 bp, Artificial Sequence
  Synthetic Construct
caagatgggtctatgctggaaca

SEQ ID NO: 31919 - DNA, 22 bp, Artificial Sequence
  Synthetic Construct
gggctttctccttcagcaaaga

SEQ ID NO: 31920 - DNA, 20 bp, Artificial Sequence
  Synthetic Construct
gcagaaccagaaggccgaat

SEQ ID NO: 31921 - DNA, 23 bp, Artificial Sequence
  Synthetic Construct
ggggcaaaacctggagtcagatg

SEQ ID NO: 31922 - DNA, 20 bp, Artificial Sequence
  Synthetic Construct
atgctgagctgcaccgtact

SEQ ID NO: 31923 - DNA, 23 bp, Artificial Sequence
  Synthetic Construct
gaggcatccaaccaacagttttc

SEQ ID NO: 31924 - DNA, 29 bp, Artificial Sequence
  Synthetic Construct
ctgaagacttaaaccaaagttggcagaac

SEQ ID NO: 31925 - DNA, 23 bp, Artificial Sequence
  Synthetic Construct
acttttagctcagggtcatgctt

SEQ ID NO: 31926 - DNA, 19 bp, Artificial Sequence
  Synthetic Construct
agagccacgagggctcaaa

SEQ ID NO: 31927 - DNA, 20 bp, Artificial Sequence
  Synthetic Construct
tcctgagtgccctaccttgt

SEQ ID NO: 31928 - DNA, 26 bp, Artificial Sequence
  Synthetic Construct
gccatgttaaactgcatcacctctaa

SEQ ID NO: 31929 - DNA, 22 bp, Artificial Sequence
  Synthetic Construct
caccactgtggagaggaaggta

SEQ ID NO: 31930 - DNA, 22 bp, Artificial Sequence
  Synthetic Construct
caggttcttggcgttttgaaca

SEQ ID NO: 31931 - DNA, 22 bp, Artificial Sequence
  Synthetic Construct
gcattgcaagtgttgtgacaga

SEQ ID NO: 31932 - DNA, 22 bp, Artificial Sequence
  Synthetic Construct
tttcctggaggccattttgtca

SEQ ID NO: 31933 - DNA, 22 bp, Artificial Sequence
  Synthetic Construct
tccagagtcccttgcttcatca

SEQ ID NO: 31934 - DNA, 22 bp, Artificial Sequence
  Synthetic Construct
cactgccagagcaacaagaaac

SEQ ID NO: 31935 - DNA, 22 bp, Artificial Sequence
  Synthetic Construct
gaagggagggagtagggaaagt

SEQ ID NO: 31936 - DNA, 22 bp, Artificial Sequence
  Synthetic Construct
ggctgagggatggggaagaaga

SEQ ID NO: 31937 - DNA, 22 bp, Artificial Sequence
  Synthetic Construct
ccccgtccaccccttctactat

SEQ ID NO: 31938 - DNA, 25 bp, Artificial Sequence
  Synthetic Construct
aattcagggacagaactgagagatg

SEQ ID NO: 31939 - DNA, 29 bp, Artificial Sequence
  Synthetic Construct
ccaggttgagaaaggaagtagctttattc

SEQ ID NO: 31940 - DNA, 22 bp, Artificial Sequence
  Synthetic Construct
cctggtggtgactggtggatta

SEQ ID NO: 31941 - DNA, 22 bp, Artificial Sequence
  Synthetic Construct
tcttcctcccctcactcccaaa

SEQ ID NO: 31942 - DNA, 22 bp, Artificial Sequence
  Synthetic Construct
gtctgcagcaaaccggaggtat

SEQ ID NO: 31943 - DNA, 22 bp, Artificial Sequence
  Synthetic Construct
gagctgcaacaaccatggaaat

SEQ ID NO: 31944 - DNA, 26 bp, Artificial Sequence
  Synthetic Construct
gctagtaaagtaacaaccctccttgt

SEQ ID NO: 31945 - DNA, 26 bp, Artificial Sequence
  Synthetic Construct
gggaaaaatgactcccttcacttcaa

SEQ ID NO: 31946 - DNA, 22 bp, Artificial Sequence
  Synthetic Construct
ccctggtgaccgggaaaatgat

SEQ ID NO: 31947 - DNA, 20 bp, Artificial Sequence
  Synthetic Construct
gggctgctcctcgttttgta

SEQ ID NO: 31948 - DNA, 25 bp, Artificial Sequence
  Synthetic Construct
gccaccacaataatccagtggaaag

SEQ ID NO: 31949 - DNA, 22 bp, Artificial Sequence
  Synthetic Construct
agctgtcaggacttgggtaact

SEQ ID NO: 31950 - DNA, 25 bp, Artificial Sequence
  Synthetic Construct
cgaggatatcttagtggcattgctt

SEQ ID NO: 31951 - DNA, 23 bp, Artificial Sequence
  Synthetic Construct
gggttgacactcaaatgcctctt

SEQ ID NO: 31952 - DNA, 25 bp, Artificial Sequence
  Synthetic Construct
ttgcattcattaccaccttcaccta

SEQ ID NO: 31953 - DNA, 27 bp, Artificial Sequence
  Synthetic Construct
cagaattggagactagtgggtggatac

SEQ ID NO: 31954 - DNA, 24 bp, Artificial Sequence
  Synthetic Construct
ggcttactccagacaccattgctt

SEQ ID NO: 31955 - DNA, 24 bp, Artificial Sequence
  Synthetic Construct
ggctgggaatggtaagccttatac

SEQ ID NO: 31956 - DNA, 25 bp, Artificial Sequence
  Synthetic Construct
ggtgagaagcccatggaagtattga

SEQ ID NO: 31957 - DNA, 22 bp, Artificial Sequence
  Synthetic Construct
ggcctccagccctgatttcata

SEQ ID NO: 31958 - DNA, 24 bp, Artificial Sequence
  Synthetic Construct
catggcatgatccctgactcatag

SEQ ID NO: 31959 - DNA, 21 bp, Artificial Sequence
  Synthetic Construct
ctgaagtgccccagctttaga

SEQ ID NO: 31960 - DNA, 20 bp, Artificial Sequence
  Synthetic Construct
gccagaattggccagagcat

SEQ ID NO: 31961 - DNA, 24 bp, Artificial Sequence
  Synthetic Construct
actgtacggttaaacatcgtctgt

SEQ ID NO: 31962 - DNA, 27 bp, Artificial Sequence
  Synthetic Construct
cttctctcctgctggatatacacatct

SEQ ID NO: 31963 - DNA, 25 bp, Artificial Sequence
  Synthetic Construct
tgttacgtgtagaatgatggtgcat

SEQ ID NO: 31964 - DNA, 22 bp, Artificial Sequence
  Synthetic Construct
agagggaaactctggccaaaaa

SEQ ID NO: 31965 - DNA, 23 bp, Artificial Sequence
  Synthetic Construct
gtgaactgcttcacagaggtttc

SEQ ID NO: 31966 - DNA, 27 bp, Artificial Sequence
  Synthetic Construct
cagcagaaagtagctgcattacctaag

SEQ ID NO: 31967 - DNA, 20 bp, Artificial Sequence
  Synthetic Construct
ttggcagggcggtgtttctt

SEQ ID NO: 31968 - DNA, 22 bp, Artificial Sequence
  Synthetic Construct
acttgggaggtggaatcacttg

SEQ ID NO: 31969 - DNA, 21 bp, Artificial Sequence
  Synthetic Construct
ccatggtcgccatcttgaagt

SEQ ID NO: 31970 - DNA, 23 bp, Artificial Sequence
  Synthetic Construct
acagaaagggcagagttcattgt

SEQ ID NO: 31971 - DNA, 22 bp, Artificial Sequence
  Synthetic Construct
ccctgcctgcctagttctgttt

SEQ ID NO: 31972 - DNA, 19 bp, Artificial Sequence
  Synthetic Construct
accacgctgggctccaaag

SEQ ID NO: 31973 - DNA, 20 bp, Artificial Sequence
  Synthetic Construct
ggtgggttgcattccccttt

SEQ ID NO: 31974 - DNA, 24 bp, Artificial Sequence
  Synthetic Construct
ctgacctgtaaagcttctctgtct

SEQ ID NO: 31975 - DNA, 22 bp, Artificial Sequence
  Synthetic Construct
ggctgcaccatgaccatctgtt

SEQ ID NO: 31976 - DNA, 21 bp, Artificial Sequence
  Synthetic Construct
cgggaaggcaagggaaagagt

SEQ ID NO: 31977 - DNA, 26 bp, Artificial Sequence
  Synthetic Construct
gcagcttctttacatgtcttggttca

SEQ ID NO: 31978 - DNA, 25 bp, Artificial Sequence
  Synthetic Construct
ctgagatctatgggagcagtgagaa

SEQ ID NO: 31979 - DNA, 25 bp, Artificial Sequence
  Synthetic Construct
gcaaaattgccactcatgtggattg

SEQ ID NO: 31980 - DNA, 22 bp, Artificial Sequence
  Synthetic Construct
cctccagcaaaggagtcagtct

SEQ ID NO: 31981 - DNA, 24 bp, Artificial Sequence
  Synthetic Construct
acatgtgtagggtaggaagtctga

SEQ ID NO: 31982 - DNA, 27 bp, Artificial Sequence
  Synthetic Construct
cagaggctactccttttacactgcata

SEQ ID NO: 31983 - DNA, 20 bp, Artificial Sequence
  Synthetic Construct
tctgagccccagcttcctta

SEQ ID NO: 31984 - DNA, 20 bp, Artificial Sequence
  Synthetic Construct
ccacaccccatagccacaca

SEQ ID NO: 31985 - DNA, 25 bp, Artificial Sequence
  Synthetic Construct
gcagagaaggtggaaaggagataga

SEQ ID NO: 31986 - DNA, 22 bp, Artificial Sequence
  Synthetic Construct
cccagagtcgacccacattttg

SEQ ID NO: 31987 - DNA, 22 bp, Artificial Sequence
  Synthetic Construct
cggctctggcgtattgtagcat

SEQ ID NO: 31988 - DNA, 24 bp, Artificial Sequence
  Synthetic Construct
gccctgaagctcatcaattcattc

SEQ ID NO: 31989 - DNA, 22 bp, Artificial Sequence
  Synthetic Construct
ttgtcctggcctagggatgagt

SEQ ID NO: 31990 - DNA, 22 bp, Artificial Sequence
  Synthetic Construct
gccaggcctgcttcattgtcta

SEQ ID NO: 31991 - DNA, 23 bp, Artificial Sequence
  Synthetic Construct
tggaggaagtgaggcttatgcta

SEQ ID NO: 31992 - DNA, 22 bp, Artificial Sequence
  Synthetic Construct
caggcaaactatccctggttgt

SEQ ID NO: 31993 - DNA, 22 bp, Artificial Sequence
  Synthetic Construct
ccaaccaggtgtctccagaact

SEQ ID NO: 31994 - DNA, 19 bp, Artificial Sequence
  Synthetic Construct
gcagggctggtgtgtgaat

SEQ ID NO: 31995 - DNA, 22 bp, Artificial Sequence
  Synthetic Construct
ctgcgttctggaagctcgtttg

SEQ ID NO: 31996 - DNA, 21 bp, Artificial Sequence
  Synthetic Construct
ggatgtttccctgcaggatgt

SEQ ID NO: 31997 - DNA, 26 bp, Artificial Sequence
  Synthetic Construct
ggagagcaaaagaacgcttttcaatg

SEQ ID NO: 31998 - DNA, 19 bp, Artificial Sequence
  Synthetic Construct
cggggaaggtgcaggacat

SEQ ID NO: 31999 - DNA, 22 bp, Artificial Sequence
  Synthetic Construct
cgaccagccagggtgataagaa

SEQ ID NO: 32000 - DNA, 21 bp, Artificial Sequence
  Synthetic Construct
acaggaggtgctgatgtctca

SEQ ID NO: 32001 - DNA, 24 bp, Artificial Sequence
  Synthetic Construct
gctccattgtcttctggttttgaa

SEQ ID NO: 32002 - DNA, 23 bp, Artificial Sequence
  Synthetic Construct
gtgctgaagaggctctgagtcat

SEQ ID NO: 32003 - DNA, 22 bp, Artificial Sequence
  Synthetic Construct
gagagctgcagggtgtttgaga

SEQ ID NO: 32004 - DNA, 22 bp, Artificial Sequence
  Synthetic Construct
gtcaggtatcgcgctggaagtt

SEQ ID NO: 32005 - DNA, 25 bp, Artificial Sequence
  Synthetic Construct
aaaagaaggccttggagagttctaa

SEQ ID NO: 32006 - DNA, 20 bp, Artificial Sequence
  Synthetic Construct
aggtgcctctgtagctgagt

SEQ ID NO: 32007 - DNA, 23 bp, Artificial Sequence
  Synthetic Construct
gggagccaaaggttttcaggaat

SEQ ID NO: 32008 - DNA, 25 bp, Artificial Sequence
  Synthetic Construct
gctgatgcatccatgaaagactaca

SEQ ID NO: 32009 - DNA, 20 bp, Artificial Sequence
  Synthetic Construct
acctctggacaggcagatga

SEQ ID NO: 32010 - DNA, 24 bp, Artificial Sequence
  Synthetic Construct
gcagaatggatagagcttggtact

SEQ ID NO: 32011 - DNA, 22 bp, Artificial Sequence
  Synthetic Construct
ccaccccactcccattgtttga

SEQ ID NO: 32012 - DNA, 20 bp, Artificial Sequence
  Synthetic Construct
aggaccagtgctccaagtca

SEQ ID NO: 32013 - DNA, 25 bp, Artificial Sequence
  Synthetic Construct
agcccaacacatttgagcattacta

SEQ ID NO: 32014 - DNA, 20 bp, Artificial Sequence
  Synthetic Construct
cccttcttcgcgtgtgtgtt

SEQ ID NO: 32015 - DNA, 22 bp, Artificial Sequence
  Synthetic Construct
tgctgtcctggaggtgttgaag

SEQ ID NO: 32016 - DNA, 23 bp, Artificial Sequence
  Synthetic Construct
ggaagggcagtggtacctattca

SEQ ID NO: 32017 - DNA, 23 bp, Artificial Sequence
  Synthetic Construct
gagggttttccccacaacctcta

SEQ ID NO: 32018 - DNA, 26 bp, Artificial Sequence
  Synthetic Construct
ggacacccttccaaatggttttcttc

SEQ ID NO: 32019 - DNA, 24 bp, Artificial Sequence
  Synthetic Construct
ggaagctggtgatccacatttttg

SEQ ID NO: 32020 - DNA, 24 bp, Artificial Sequence
  Synthetic Construct
gcactcatgtgctatgagggagtt

SEQ ID NO: 32021 - DNA, 24 bp, Artificial Sequence
  Synthetic Construct
ggctgtagcctgagtctctgtttg

SEQ ID NO: 32022 - DNA, 22 bp, Artificial Sequence
  Synthetic Construct
agcccactggtggtcatttaag

SEQ ID NO: 32023 - DNA, 28 bp, Artificial Sequence
  Synthetic Construct
gtgatgaggatcatgggaagggaataaa

SEQ ID NO: 32024 - DNA, 24 bp, Artificial Sequence
  Synthetic Construct
gagctccaccctagagcaatgaag

SEQ ID NO: 32025 - DNA, 20 bp, Artificial Sequence
  Synthetic Construct
tggagaggacacccctcaaa

SEQ ID NO: 32026 - DNA, 29 bp, Artificial Sequence
  Synthetic Construct
gccctatttttagtataaccctggagcat

SEQ ID NO: 32027 - DNA, 24 bp, Artificial Sequence
  Synthetic Construct
cccgcaaatcaagcatcagcttac

SEQ ID NO: 32028 - DNA, 20 bp, Artificial Sequence
  Synthetic Construct
tcagagcctcacgcctgaat

SEQ ID NO: 32029 - DNA, 22 bp, Artificial Sequence
  Synthetic Construct
ccccacccatgatacgttgttc

SEQ ID NO: 32030 - DNA, 29 bp, Artificial Sequence
  Synthetic Construct
ctcataaagtaagacacaccgtaccaatg

SEQ ID NO: 32031 - DNA, 24 bp, Artificial Sequence
  Synthetic Construct
cctagattctggaacgccttgttc

SEQ ID NO: 32032 - DNA, 23 bp, Artificial Sequence
  Synthetic Construct
ggccagtgcatttttctccatag

SEQ ID NO: 32033 - DNA, 20 bp, Artificial Sequence
  Synthetic Construct
tgctcacctccaggaagact

SEQ ID NO: 32034 - DNA, 22 bp, Artificial Sequence
  Synthetic Construct
ggagtcctaggctgtcagaaac

SEQ ID NO: 32035 - DNA, 25 bp, Artificial Sequence
  Synthetic Construct
gacacaatgactggaatttgcttca

SEQ ID NO: 32036 - DNA, 24 bp, Artificial Sequence
  Synthetic Construct
cattgtgcaaccagaactgagatt

SEQ ID NO: 32037 - DNA, 23 bp, Artificial Sequence
  Synthetic Construct
cagagtaggcaccaccatctatc

SEQ ID NO: 32038 - DNA, 20 bp, Artificial Sequence
  Synthetic Construct
tgcagccacccgaatgagat

SEQ ID NO: 32039 - DNA, 25 bp, Artificial Sequence
  Synthetic Construct
ctttgtggtgcaaatctgatcttct

SEQ ID NO: 32040 - DNA, 27 bp, Artificial Sequence
  Synthetic Construct
cactggagtgcttactgaatgaaaaca

SEQ ID NO: 32041 - DNA, 20 bp, Artificial Sequence
  Synthetic Construct
aaagctgaggggtggagaga

SEQ ID NO: 32042 - DNA, 25 bp, Artificial Sequence
  Synthetic Construct
gcaggtgctaaggactgtaagaagt

SEQ ID NO: 32043 - DNA, 26 bp, Artificial Sequence
  Synthetic Construct
cacccctttagagctaaggaaacaag

SEQ ID NO: 32044 - DNA, 22 bp, Artificial Sequence
  Synthetic Construct
gagacagaggtccagaggtgtt

SEQ ID NO: 32045 - DNA, 25 bp, Artificial Sequence
  Synthetic Construct
tgtcagtcataaccttggatgctaa

SEQ ID NO: 32046 - DNA, 22 bp, Artificial Sequence
  Synthetic Construct
ggaaccagagctgaggctgtta

SEQ ID NO: 32047 - DNA, 20 bp, Artificial Sequence
  Synthetic Construct
actctgggtgtgtcggcatt

SEQ ID NO: 32048 - DNA, 22 bp, Artificial Sequence
  Synthetic Construct
accctcgtggcatcagagatga

SEQ ID NO: 32049 - DNA, 19 bp, Artificial Sequence
  Synthetic Construct
agtgggcccagtggaggaa

SEQ ID NO: 32050 - DNA, 22 bp, Artificial Sequence
  Synthetic Construct
gtgggctgggcttaatggtatg

SEQ ID NO: 32051 - DNA, 21 bp, Artificial Sequence
  Synthetic Construct
cccagtacgctaggcagaaga

SEQ ID NO: 32052 - DNA, 23 bp, Artificial Sequence
  Synthetic Construct
ctgccaagctcactagaggtaac

SEQ ID NO: 32053 - DNA, 20 bp, Artificial Sequence
  Synthetic Construct
gccaggtcgacacgtaacat

SEQ ID NO: 32054 - DNA, 23 bp, Artificial Sequence
  Synthetic Construct
ccaccctctttctcatcacagtt

SEQ ID NO: 32055 - DNA, 24 bp, Artificial Sequence
  Synthetic Construct
ggacataagacccatccaccaatg

SEQ ID NO: 32056 - DNA, 27 bp, Artificial Sequence
  Synthetic Construct
ggtctgtaaagttgccatgaatactga

SEQ ID NO: 32057 - DNA, 26 bp, Artificial Sequence
  Synthetic Construct
tgtccttgggaagaagtgagtttaag

SEQ ID NO: 32058 - DNA, 27 bp, Artificial Sequence
  Synthetic Construct
ccctgaaaataatacccagctttcatc

SEQ ID NO: 32059 - DNA, 25 bp, Artificial Sequence
  Synthetic Construct
catctgagctgaggtcatgttcttc

SEQ ID NO: 32060 - DNA, 20 bp, Artificial Sequence
  Synthetic Construct
gggcaggtgtttcaggaagt

SEQ ID NO: 32061 - DNA, 27 bp, Artificial Sequence
  Synthetic Construct
agtaactatctcaagtcacaggagtct

SEQ ID NO: 32062 - DNA, 27 bp, Artificial Sequence
  Synthetic Construct
catagttgctaaataacgggagctact

SEQ ID NO: 32063 - DNA, 24 bp, Artificial Sequence
  Synthetic Construct
ggtcattcagaccagctccaataa

SEQ ID NO: 32064 - DNA, 22 bp, Artificial Sequence
  Synthetic Construct
ggccagtggcacattagcaaac

SEQ ID NO: 32065 - DNA, 22 bp, Artificial Sequence
  Synthetic Construct
cagtcaccctgggatgagagta

SEQ ID NO: 32066 - DNA, 22 bp, Artificial Sequence
  Synthetic Construct
tggtgctgcttagcatttcgta

SEQ ID NO: 32067 - DNA, 20 bp, Artificial Sequence
  Synthetic Construct
agaacaggcaagcccactca

SEQ ID NO: 32068 - DNA, 22 bp, Artificial Sequence
  Synthetic Construct
acaacctgtggtctacctgagt

SEQ ID NO: 32069 - DNA, 26 bp, Artificial Sequence
  Synthetic Construct
gatctctggagaatttgggagtatgt

SEQ ID NO: 32070 - DNA, 23 bp, Artificial Sequence
  Synthetic Construct
ggccagagcacctgttctctaaa

SEQ ID NO: 32071 - DNA, 23 bp, Artificial Sequence
  Synthetic Construct
cagggagtctcgccatctgtaac

SEQ ID NO: 32072 - DNA, 27 bp, Artificial Sequence
  Synthetic Construct
caggttagggagattatcttgcttttc

SEQ ID NO: 32073 - DNA, 22 bp, Artificial Sequence
  Synthetic Construct
gccctaaaaccctgctgagatg

SEQ ID NO: 32074 - DNA, 23 bp, Artificial Sequence
  Synthetic Construct
cctgaatcagccagcatagagtt

SEQ ID NO: 32075 - DNA, 25 bp, Artificial Sequence
  Synthetic Construct
ctttcttccatggatcagctgagat

SEQ ID NO: 32076 - DNA, 24 bp, Artificial Sequence
  Synthetic Construct
gttgcagtctaggttttgttggtt

SEQ ID NO: 32077 - DNA, 26 bp, Artificial Sequence
  Synthetic Construct
ggctagggtaggagtagagcagtatc

SEQ ID NO: 32078 - DNA, 20 bp, Artificial Sequence
  Synthetic Construct
ccggaggcccaaacgttaaa

SEQ ID NO: 32079 - DNA, 29 bp, Artificial Sequence
  Synthetic Construct
ccttggagattcattcgatagctacttgt

SEQ ID NO: 32080 - DNA, 20 bp, Artificial Sequence
  Synthetic Construct
tgacagcccactctcacctt

SEQ ID NO: 32081 - DNA, 21 bp, Artificial Sequence
  Synthetic Construct
acctggtcagcactggcttct

SEQ ID NO: 32082 - DNA, 23 bp, Artificial Sequence
  Synthetic Construct
ggagagaactgggctctgaaaac

SEQ ID NO: 32083 - DNA, 24 bp, Artificial Sequence
  Synthetic Construct
gaggcacagaacatgctaccaaag

SEQ ID NO: 32084 - DNA, 28 bp, Artificial Sequence
  Synthetic Construct
cccatgccataagtaggattgtgacttc

SEQ ID NO: 32085 - DNA, 23 bp, Artificial Sequence
  Synthetic Construct
atgaggaaaacgagggtttctgt

SEQ ID NO: 32086 - DNA, 19 bp, Artificial Sequence
  Synthetic Construct
agcagccccacagtgcaaa

SEQ ID NO: 32087 - DNA, 24 bp, Artificial Sequence
  Synthetic Construct
ggtaggttcagggagctggaatga

SEQ ID NO: 32088 - DNA, 26 bp, Artificial Sequence
  Synthetic Construct
ggtactgtttcttccataaccaggat

SEQ ID NO: 32089 - DNA, 24 bp, Artificial Sequence
  Synthetic Construct
tggtttagcagtgcagataaggaa

SEQ ID NO: 32090 - DNA, 23 bp, Artificial Sequence
  Synthetic Construct
agcagaatggggtgaaaaaggtt

SEQ ID NO: 32091 - DNA, 21 bp, Artificial Sequence
  Synthetic Construct
gagggcacccctgaaaaatgt

SEQ ID NO: 32092 - DNA, 23 bp, Artificial Sequence
  Synthetic Construct
actcaatagctgcccttcctact

SEQ ID NO: 32093 - DNA, 26 bp, Artificial Sequence
  Synthetic Construct
gatgtctggaaagatgttggatgatg

SEQ ID NO: 32094 - DNA, 20 bp, Artificial Sequence
  Synthetic Construct
gagggtgtcctgggcattac

SEQ ID NO: 32095 - DNA, 25 bp, Artificial Sequence
  Synthetic Construct
caaatgcaatggtaggtgatgagtt

SEQ ID NO: 32096 - DNA, 19 bp, Artificial Sequence
  Synthetic Construct
agccgcaaggagtgcattt

SEQ ID NO: 32097 - DNA, 28 bp, Artificial Sequence
  Synthetic Construct
ggacatttgggtttaaccagcctaattc

SEQ ID NO: 32098 - DNA, 25 bp, Artificial Sequence
  Synthetic Construct
cctgttgcaccaaatcaatgtgtct

SEQ ID NO: 32099 - DNA, 25 bp, Artificial Sequence
  Synthetic Construct
caaaatcccaaagtagtgcctgagt

SEQ ID NO: 32100 - DNA, 23 bp, Artificial Sequence
  Synthetic Construct
gggtagtcctgatgggtaacaga

SEQ ID NO: 32101 - DNA, 22 bp, Artificial Sequence
  Synthetic Construct
accaaccagcatctctctcagt

SEQ ID NO: 32102 - DNA, 24 bp, Artificial Sequence
  Synthetic Construct
tggtttgatcttagaccgtgacaa

SEQ ID NO: 32103 - DNA, 26 bp, Artificial Sequence
  Synthetic Construct
gtcttcacagtagggcttttgctatg

SEQ ID NO: 32104 - DNA, 24 bp, Artificial Sequence
  Synthetic Construct
cctggatcccaggcctgtttatag

SEQ ID NO: 32105 - DNA, 25 bp, Artificial Sequence
  Synthetic Construct
gttttcaaaagctgtggttgctgaa

SEQ ID NO: 32106 - DNA, 28 bp, Artificial Sequence
  Synthetic Construct
ggaagctgtactgtagaaactagcctaa

SEQ ID NO: 32107 - DNA, 24 bp, Artificial Sequence
  Synthetic Construct
ctcagactgtggcttatgatgtct

SEQ ID NO: 32108 - DNA, 23 bp, Artificial Sequence
  Synthetic Construct
ccttaaggggccttgggtacatc

SEQ ID NO: 32109 - DNA, 24 bp, Artificial Sequence
  Synthetic Construct
gctcagctgtaggagatttgttct

SEQ ID NO: 32110 - DNA, 20 bp, Artificial Sequence
  Synthetic Construct
tccgtgtccacctggtcaaa

SEQ ID NO: 32111 - DNA, 25 bp, Artificial Sequence
  Synthetic Construct
gccaaagccagtgcataattagttg

SEQ ID NO: 32112 - DNA, 27 bp, Artificial Sequence
  Synthetic Construct
ctctgctttagcatttgccactaatac

SEQ ID NO: 32113 - DNA, 22 bp, Artificial Sequence
  Synthetic Construct
cacagaagtccagcggcattga

SEQ ID NO: 32114 - DNA, 27 bp, Artificial Sequence
  Synthetic Construct
ggagtcaagaaagtcgagcctgtaaaa

SEQ ID NO: 32115 - DNA, 24 bp, Artificial Sequence
  Synthetic Construct
gaaggttccagcaggtgtagaatg

SEQ ID NO: 32116 - DNA, 25 bp, Artificial Sequence
  Synthetic Construct
gagtgggagctctaacttgacacta

SEQ ID NO: 32117 - DNA, 27 bp, Artificial Sequence
  Synthetic Construct
cccaggcttgactctttttacacattg

SEQ ID NO: 32118 - DNA, 25 bp, Artificial Sequence
  Synthetic Construct
actaatattcactggccaactgtga

SEQ ID NO: 32119 - DNA, 22 bp, Artificial Sequence
  Synthetic Construct
ggacaggctgggatggaaaatg

SEQ ID NO: 32120 - DNA, 26 bp, Artificial Sequence
  Synthetic Construct
cagtcagacaagtcctgagtaagaga

SEQ ID NO: 32121 - DNA, 22 bp, Artificial Sequence
  Synthetic Construct
aggctgcgaccttcttcagaga

SEQ ID NO: 32122 - DNA, 20 bp, Artificial Sequence
  Synthetic Construct
gtggatgcagctgccaatga

SEQ ID NO: 32123 - DNA, 20 bp, Artificial Sequence
  Synthetic Construct
atgcaccccaggccccactt

SEQ ID NO: 32124 - DNA, 30 bp, Artificial Sequence
  Synthetic Construct
ccagaaacaaccttagtattgcaacctttc

SEQ ID NO: 32125 - DNA, 22 bp, Artificial Sequence
  Synthetic Construct
ttcctcggtcacctccacaatc

SEQ ID NO: 32126 - DNA, 29 bp, Artificial Sequence
  Synthetic Construct
gaaaatagtctctctgaaggagcaagtag

SEQ ID NO: 32127 - DNA, 21 bp, Artificial Sequence
  Synthetic Construct
tggtgatcgcagcagaaacaa

SEQ ID NO: 32128 - DNA, 22 bp, Artificial Sequence
  Synthetic Construct
gtgggcagaggcatgcatataa

SEQ ID NO: 32129 - DNA, 22 bp, Artificial Sequence
  Synthetic Construct
gtgagcctcaagagacgggaaa

SEQ ID NO: 32130 - DNA, 25 bp, Artificial Sequence
  Synthetic Construct
gcctactagtgctattcccctgaga

SEQ ID NO: 32131 - DNA, 26 bp, Artificial Sequence
  Synthetic Construct
gcttgggtaggatttatgcctgtcaa

SEQ ID NO: 32132 - DNA, 28 bp, Artificial Sequence
  Synthetic Construct
gctccactaaaataccgagttggttcat

SEQ ID NO: 32133 - DNA, 24 bp, Artificial Sequence
  Synthetic Construct
tgatcagaggtctaggcacaactt

SEQ ID NO: 32134 - DNA, 23 bp, Artificial Sequence
  Synthetic Construct
actttctggcaggagtgagtttc

SEQ ID NO: 32135 - DNA, 24 bp, Artificial Sequence
  Synthetic Construct
agtagccactagatggcagaattg

SEQ ID NO: 32136 - DNA, 20 bp, Artificial Sequence
  Synthetic Construct
tccaggccctctgattccaa

SEQ ID NO: 32137 - DNA, 24 bp, Artificial Sequence
  Synthetic Construct
ggaactgttgtgctgaaaatgtct

SEQ ID NO: 32138 - DNA, 27 bp, Artificial Sequence
  Synthetic Construct
tggccttatataactgtagggttgact

SEQ ID NO: 32139 - DNA, 22 bp, Artificial Sequence
  Synthetic Construct
gcttcccagcacagatggaatc

SEQ ID NO: 32140 - DNA, 22 bp, Artificial Sequence
  Synthetic Construct
gcggagggagagcactttgttt

SEQ ID NO: 32141 - DNA, 26 bp, Artificial Sequence
  Synthetic Construct
gctgaaatcttgcagaaaccagagtt

SEQ ID NO: 32142 - DNA, 22 bp, Artificial Sequence
  Synthetic Construct
tgggtaagctcacatgctctca

SEQ ID NO: 32143 - DNA, 25 bp, Artificial Sequence
  Synthetic Construct
gcgtatcacaagccaatgctaagtt

SEQ ID NO: 32144 - DNA, 24 bp, Artificial Sequence
  Synthetic Construct
gatgagaatttgcagggcatggta

SEQ ID NO: 32145 - DNA, 24 bp, Artificial Sequence
  Synthetic Construct
gggaaggaaggtgtgttccctaag

SEQ ID NO: 32146 - DNA, 22 bp, Artificial Sequence
  Synthetic Construct
gcagagaccaggtaagcagaca

SEQ ID NO: 32147 - DNA, 23 bp, Artificial Sequence
  Synthetic Construct
gtcagttgagtggtgaaggcaaa

SEQ ID NO: 32148 - DNA, 24 bp, Artificial Sequence
  Synthetic Construct
aaggtacaagaggcatttctgaca

SEQ ID NO: 32149 - DNA, 23 bp, Artificial Sequence
  Synthetic Construct
tccagaaagatggcctgactttg

SEQ ID NO: 32150 - DNA, 25 bp, Artificial Sequence
  Synthetic Construct
gactctttggaggaccaaggtcaag

SEQ ID NO: 32151 - DNA, 24 bp, Artificial Sequence
  Synthetic Construct
tgctcaaggacaaaaatggtcact

SEQ ID NO: 32152 - DNA, 26 bp, Artificial Sequence
  Synthetic Construct
ccatcttctgtatttgacccgaatct

SEQ ID NO: 32153 - DNA, 21 bp, Artificial Sequence
  Synthetic Construct
tgcagggatgctgggacatca

SEQ ID NO: 32154 - DNA, 25 bp, Artificial Sequence
  Synthetic Construct
gagcaaagaccatgctttacacatc

SEQ ID NO: 32155 - DNA, 20 bp, Artificial Sequence
  Synthetic Construct
agagcgcttgggtagagaga

SEQ ID NO: 32156 - DNA, 24 bp, Artificial Sequence
  Synthetic Construct
cctaatggaacccaggtgagtgat

SEQ ID NO: 32157 - DNA, 19 bp, Artificial Sequence
  Synthetic Construct
acactggggctcactcact

SEQ ID NO: 32158 - DNA, 22 bp, Artificial Sequence
  Synthetic Construct
accacagaccacaggctgacta

SEQ ID NO: 32159 - DNA, 29 bp, Artificial Sequence
  Synthetic Construct
ctgaggcttggaattagatgtgatactga

SEQ ID NO: 32160 - DNA, 26 bp, Artificial Sequence
  Synthetic Construct
cctataagaggagaaacagagcatgt

SEQ ID NO: 32161 - DNA, 24 bp, Artificial Sequence
  Synthetic Construct
gggccatggtacctactctcttct

SEQ ID NO: 32162 - DNA, 23 bp, Artificial Sequence
  Synthetic Construct
tgcacagtcctgtgactctgtat

SEQ ID NO: 32163 - DNA, 25 bp, Artificial Sequence
  Synthetic Construct
gacagcaattcccaaagtgtttttg

SEQ ID NO: 32164 - DNA, 24 bp, Artificial Sequence
  Synthetic Construct
gcctcttcctctccacattggatt

SEQ ID NO: 32165 - DNA, 20 bp, Artificial Sequence
  Synthetic Construct
ccaaaggacagcgtgtgtga

SEQ ID NO: 32166 - DNA, 22 bp, Artificial Sequence
  Synthetic Construct
gtggacactggccatccacatt

SEQ ID NO: 32167 - DNA, 25 bp, Artificial Sequence
  Synthetic Construct
acctcacctgtcatgactattcttc

SEQ ID NO: 32168 - DNA, 22 bp, Artificial Sequence
  Synthetic Construct
ggtgcggtgagtggagatgatt

SEQ ID NO: 32169 - DNA, 25 bp, Artificial Sequence
  Synthetic Construct
gttgcaaagtgagctttgttgattg

SEQ ID NO: 32170 - DNA, 21 bp, Artificial Sequence
  Synthetic Construct
accgcagacaatctgcaagta

SEQ ID NO: 32171 - DNA, 27 bp, Artificial Sequence
  Synthetic Construct
tgatacctgagatagggaaaaggaaga

SEQ ID NO: 32172 - DNA, 26 bp, Artificial Sequence
  Synthetic Construct
gccacttttactgttgcaaacacatc

SEQ ID NO: 32173 - DNA, 22 bp, Artificial Sequence
  Synthetic Construct
gagtgggagggaaaggaagtca

SEQ ID NO: 32174 - DNA, 21 bp, Artificial Sequence
  Synthetic Construct
gctgtcttgccacttccacta

SEQ ID NO: 32175 - DNA, 20 bp, Artificial Sequence
  Synthetic Construct
gctgaagaccagcagtctgt

SEQ ID NO: 32176 - DNA, 22 bp, Artificial Sequence
  Synthetic Construct
gcatgcagcaaggagattgact

SEQ ID NO: 32177 - DNA, 22 bp, Artificial Sequence
  Synthetic Construct
ccttgctctctgcctaccattg

SEQ ID NO: 32178 - DNA, 28 bp, Artificial Sequence
  Synthetic Construct
gtgctcagaatagagcagaagtagcttt

SEQ ID NO: 32179 - DNA, 19 bp, Artificial Sequence
  Synthetic Construct
tgcgaagcagcgagcacat

SEQ ID NO: 32180 - DNA, 24 bp, Artificial Sequence
  Synthetic Construct
cacaaaagcagccatcagagacaa

SEQ ID NO: 32181 - DNA, 22 bp, Artificial Sequence
  Synthetic Construct
ccggccctgggtttacttctta

SEQ ID NO: 32182 - DNA, 22 bp, Artificial Sequence
  Synthetic Construct
gggcttggcagtcccaaataca

SEQ ID NO: 32183 - DNA, 22 bp, Artificial Sequence
  Synthetic Construct
ctgacaaagggtgccagcttct

SEQ ID NO: 32184 - DNA, 25 bp, Artificial Sequence
  Synthetic Construct
cactaagatggataaggcggaatgt

SEQ ID NO: 32185 - DNA, 23 bp, Artificial Sequence
  Synthetic Construct
tggcccagagttccataaaacat

SEQ ID NO: 32186 - DNA, 27 bp, Artificial Sequence
  Synthetic Construct
gcttatctgatttcccagcacacagaa

SEQ ID NO: 32187 - DNA, 20 bp, Artificial Sequence
  Synthetic Construct
cagcgggtgagctttcgttt

SEQ ID NO: 32188 - DNA, 24 bp, Artificial Sequence
  Synthetic Construct
cccctagaaactcccttctcttgt

SEQ ID NO: 32189 - DNA, 24 bp, Artificial Sequence
  Synthetic Construct
cccggctgctctcactacaataga

SEQ ID NO: 32190 - DNA, 22 bp, Artificial Sequence
  Synthetic Construct
ccatccccacagctctcttttc

SEQ ID NO: 32191 - DNA, 23 bp, Artificial Sequence
  Synthetic Construct
tgagtccctgaggcataatcagt

SEQ ID NO: 32192 - DNA, 22 bp, Artificial Sequence
  Synthetic Construct
cgacgggtcagtggactctaca

SEQ ID NO: 32193 - DNA, 22 bp, Artificial Sequence
  Synthetic Construct
cctgggagcactccttgtcttt

SEQ ID NO: 32194 - DNA, 25 bp, Artificial Sequence
  Synthetic Construct
aatgggaaataggcagacatacaca

SEQ ID NO: 32195 - DNA, 27 bp, Artificial Sequence
  Synthetic Construct
tgttcctctctaagaaccttctagtct

SEQ ID NO: 32196 - DNA, 25 bp, Artificial Sequence
  Synthetic Construct
ctttcctacaccctcattcagttgt

SEQ ID NO: 32197 - DNA, 23 bp, Artificial Sequence
  Synthetic Construct
aagagcgtgagccttctgttatg

SEQ ID NO: 32198 - DNA, 27 bp, Artificial Sequence
  Synthetic Construct
tgccattctttaatcccttggagttag

SEQ ID NO: 32199 - DNA, 20 bp, Artificial Sequence
  Synthetic Construct
tctaggaggcccgtcacact

SEQ ID NO: 32200 - DNA, 25 bp, Artificial Sequence
  Synthetic Construct
atgcagctcctatgtaattgctact

SEQ ID NO: 32201 - DNA, 23 bp, Artificial Sequence
  Synthetic Construct
ttcctccactgggtggttaattg

SEQ ID NO: 32202 - DNA, 21 bp, Artificial Sequence
  Synthetic Construct
gcggcagctagcgtattttga

SEQ ID NO: 32203 - DNA, 27 bp, Artificial Sequence
  Synthetic Construct
gtggtatggtgtttgcattatgctgta

SEQ ID NO: 32204 - DNA, 20 bp, Artificial Sequence
  Synthetic Construct
agcccagctcaggttcaact

SEQ ID NO: 32205 - DNA, 23 bp, Artificial Sequence
  Synthetic Construct
tgggccataatgggacaaagatg

SEQ ID NO: 32206 - DNA, 25 bp, Artificial Sequence
  Synthetic Construct
ggaggccaaaggagcttatggttac

SEQ ID NO: 32207 - DNA, 23 bp, Artificial Sequence
  Synthetic Construct
caccatagtccacaaagcactct

SEQ ID NO: 32208 - DNA, 22 bp, Artificial Sequence
  Synthetic Construct
gccttcgaacacagactgaaga

SEQ ID NO: 32209 - DNA, 25 bp, Artificial Sequence
  Synthetic Construct
agagctcttttgcctaaacttgttc

SEQ ID NO: 32210 - DNA, 21 bp, Artificial Sequence
  Synthetic Construct
ccagggcccttggatttttga

SEQ ID NO: 32211 - DNA, 27 bp, Artificial Sequence
  Synthetic Construct
caagaggacgtaagtccaatgttaagt

SEQ ID NO: 32212 - DNA, 23 bp, Artificial Sequence
  Synthetic Construct
gccttccctagccacccatctaa

SEQ ID NO: 32213 - DNA, 23 bp, Artificial Sequence
  Synthetic Construct
tgttcggtaccgttgtcttttct

SEQ ID NO: 32214 - DNA, 25 bp, Artificial Sequence
  Synthetic Construct
cagagatgcctcaatctcattgcat

SEQ ID NO: 32215 - DNA, 24 bp, Artificial Sequence
  Synthetic Construct
ggtacaaagggcaaacgtgttcat

SEQ ID NO: 32216 - DNA, 25 bp, Artificial Sequence
  Synthetic Construct
ggctcctgattcttaaacagagctt

SEQ ID NO: 32217 - DNA, 23 bp, Artificial Sequence
  Synthetic Construct
ggtggctctgatgctccctaaag

SEQ ID NO: 32218 - DNA, 25 bp, Artificial Sequence
  Synthetic Construct
aatgtgggaagggtctactttcaat

SEQ ID NO: 32219 - DNA, 28 bp, Artificial Sequence
  Synthetic Construct
ctggttaggaatctgcaggaaaaacaac

SEQ ID NO: 32220 - DNA, 28 bp, Artificial Sequence
  Synthetic Construct
cgtatagtcttccatgccatcttcacta

SEQ ID NO: 32221 - DNA, 22 bp, Artificial Sequence
  Synthetic Construct
tctcaggctcagggagagtcat

SEQ ID NO: 32222 - DNA, 24 bp, Artificial Sequence
  Synthetic Construct
agagtaagcactttgccataggtt

SEQ ID NO: 32223 - DNA, 26 bp, Artificial Sequence
  Synthetic Construct
cagggttcaggatgaattctacaaca

SEQ ID NO: 32224 - DNA, 26 bp, Artificial Sequence
  Synthetic Construct
gcagcagcactaagaatcacaacttt

SEQ ID NO: 32225 - DNA, 20 bp, Artificial Sequence
  Synthetic Construct
tggccccagaggcatctaaa

SEQ ID NO: 32226 - DNA, 23 bp, Artificial Sequence
  Synthetic Construct
cacaggaagtcacctgcaaggaa

SEQ ID NO: 32227 - DNA, 22 bp, Artificial Sequence
  Synthetic Construct
tggctgtttagggtgctttcaa

SEQ ID NO: 32228 - DNA, 28 bp, Artificial Sequence
  Synthetic Construct
ctcatcatacgagctcaagagaacaaga

SEQ ID NO: 32229 - DNA, 22 bp, Artificial Sequence
  Synthetic Construct
gttggagaaggcagtgaagtct

SEQ ID NO: 32230 - DNA, 28 bp, Artificial Sequence
  Synthetic Construct
cgagtagtctggccaaaattacatctct

SEQ ID NO: 32231 - DNA, 22 bp, Artificial Sequence
  Synthetic Construct
ccatcaaccttccttccacaca

SEQ ID NO: 32232 - DNA, 20 bp, Artificial Sequence
  Synthetic Construct
ccgctgacctcaaagcaaca

SEQ ID NO: 32233 - DNA, 21 bp, Artificial Sequence
  Synthetic Construct
ccccattccacggacagaatc

SEQ ID NO: 32234 - DNA, 29 bp, Artificial Sequence
  Synthetic Construct
gctctagataatctgatgacacggtgatg

SEQ ID NO: 32235 - DNA, 19 bp, Artificial Sequence
  Synthetic Construct
gccactggacctggcacaa

SEQ ID NO: 32236 - DNA, 24 bp, Artificial Sequence
  Synthetic Construct
tgattgacatccttttccctgtga

SEQ ID NO: 32237 - DNA, 23 bp, Artificial Sequence
  Synthetic Construct
ctccagcacctacactaccctaa

SEQ ID NO: 32238 - DNA, 22 bp, Artificial Sequence
  Synthetic Construct
ccccagaaggcagcaagtcaat

SEQ ID NO: 32239 - DNA, 24 bp, Artificial Sequence
  Synthetic Construct
gctttgtcacagctgttttaggaa

SEQ ID NO: 32240 - DNA, 25 bp, Artificial Sequence
  Synthetic Construct
gggtctctcaggtgtgttcagtaga

SEQ ID NO: 32241 - DNA, 24 bp, Artificial Sequence
  Synthetic Construct
gcaggcctaggactatttctctga

SEQ ID NO: 32242 - DNA, 24 bp, Artificial Sequence
  Synthetic Construct
gagagtgagcaaggagagtgttta

SEQ ID NO: 32243 - DNA, 26 bp, Artificial Sequence
  Synthetic Construct
ctgacagaatattggagtgggtgatg

SEQ ID NO: 32244 - DNA, 25 bp, Artificial Sequence
  Synthetic Construct
tgagaccagaggtctgtatgtatga

SEQ ID NO: 32245 - DNA, 23 bp, Artificial Sequence
  Synthetic Construct
gaccaagtgtgcttgtagctcat

SEQ ID NO: 32246 - DNA, 22 bp, Artificial Sequence
  Synthetic Construct
ctctgtgtccacctgctacact

SEQ ID NO: 32247 - DNA, 19 bp, Artificial Sequence
  Synthetic Construct
ggcatccatgccaccttct

SEQ ID NO: 32248 - DNA, 22 bp, Artificial Sequence
  Synthetic Construct
ggtaggtcccagtcttcaccat

SEQ ID NO: 32249 - DNA, 20 bp, Artificial Sequence
  Synthetic Construct
ggaggacagtggcatgaaca

SEQ ID NO: 32250 - DNA, 26 bp, Artificial Sequence
  Synthetic Construct
gcagaacagatgcctcattttgctta

SEQ ID NO: 32251 - DNA, 25 bp, Artificial Sequence
  Synthetic Construct
gtgtgtgccatttgtgtttgaaaag

SEQ ID NO: 32252 - DNA, 23 bp, Artificial Sequence
  Synthetic Construct
gctccacaatgggtgttgcatgt

SEQ ID NO: 32253 - DNA, 23 bp, Artificial Sequence
  Synthetic Construct
gctgtgctccttgaagtggcatt

SEQ ID NO: 32254 - DNA, 23 bp, Artificial Sequence
  Synthetic Construct
ggaaaatgagggcattccaggta

SEQ ID NO: 32255 - DNA, 19 bp, Artificial Sequence
  Synthetic Construct
gccccgtggcttctgttct

SEQ ID NO: 32256 - DNA, 26 bp, Artificial Sequence
  Synthetic Construct
gctgtgatcctctcaatgctgtaact

SEQ ID NO: 32257 - DNA, 26 bp, Artificial Sequence
  Synthetic Construct
gggacgtaaactagagaaggcaccat

SEQ ID NO: 32258 - DNA, 22 bp, Artificial Sequence
  Synthetic Construct
agggatggagaggggaaagcat

SEQ ID NO: 32259 - DNA, 26 bp, Artificial Sequence
  Synthetic Construct
ggtcatcacagttggtatgacactct

SEQ ID NO: 32260 - DNA, 19 bp, Artificial Sequence
  Synthetic Construct
agagctctgctggcacctt

SEQ ID NO: 32261 - DNA, 22 bp, Artificial Sequence
  Synthetic Construct
ctcatcttcctcctggccctta

SEQ ID NO: 32262 - DNA, 20 bp, Artificial Sequence
  Synthetic Construct
agggccaccctctcactatg

SEQ ID NO: 32263 - DNA, 23 bp, Artificial Sequence
  Synthetic Construct
gataaggccgccattttctgaac

SEQ ID NO: 32264 - DNA, 24 bp, Artificial Sequence
  Synthetic Construct
agctgcttgggatgattatgttga

SEQ ID NO: 32265 - DNA, 23 bp, Artificial Sequence
  Synthetic Construct
catgaggcaggacttggaaaaca

SEQ ID NO: 32266 - DNA, 23 bp, Artificial Sequence
  Synthetic Construct
actttgaggcccaataaccatgt

SEQ ID NO: 32267 - DNA, 20 bp, Artificial Sequence
  Synthetic Construct
gcgtgccatttgcagtctgt

SEQ ID NO: 32268 - DNA, 23 bp, Artificial Sequence
  Synthetic Construct
acaaacctagacagcccttgttc

SEQ ID NO: 32269 - DNA, 25 bp, Artificial Sequence
  Synthetic Construct
gggtacagaagcttcaatcacatca

SEQ ID NO: 32270 - DNA, 25 bp, Artificial Sequence
  Synthetic Construct
accagcctcagatttgtcttttact

SEQ ID NO: 32271 - DNA, 19 bp, Artificial Sequence
  Synthetic Construct
tggggtggtctgtgcagtt

SEQ ID NO: 32272 - DNA, 25 bp, Artificial Sequence
  Synthetic Construct
ctgtaacagtgtctggtagcaaatg

SEQ ID NO: 32273 - DNA, 25 bp, Artificial Sequence
  Synthetic Construct
gatggagtcctgtgaagatggtaac

SEQ ID NO: 32274 - DNA, 25 bp, Artificial Sequence
  Synthetic Construct
cactaattggtgccattatgcatct

SEQ ID NO: 32275 - DNA, 24 bp, Artificial Sequence
  Synthetic Construct
tgagtacacctaatggcaggtttt

SEQ ID NO: 32276 - DNA, 19 bp, Artificial Sequence
  Synthetic Construct
caccatgcagcaccagtga

SEQ ID NO: 32277 - DNA, 21 bp, Artificial Sequence
  Synthetic Construct
ccctgaggaggggttgattgt

SEQ ID NO: 32278 - DNA, 20 bp, Artificial Sequence
  Synthetic Construct
gtgtctgcaggtgtggttgt

SEQ ID NO: 32279 - DNA, 25 bp, Artificial Sequence
  Synthetic Construct
acgagactcatccttatccctagaa

SEQ ID NO: 32280 - DNA, 22 bp, Artificial Sequence
  Synthetic Construct
tccaaattggccttccacaaca

SEQ ID NO: 32281 - DNA, 20 bp, Artificial Sequence
  Synthetic Construct
agatcgggctccagcttcta

SEQ ID NO: 32282 - DNA, 22 bp, Artificial Sequence
  Synthetic Construct
agagtgactacctccccagcaa

SEQ ID NO: 32283 - DNA, 23 bp, Artificial Sequence
  Synthetic Construct
tgcaataggctgagtccacaatg

SEQ ID NO: 32284 - DNA, 21 bp, Artificial Sequence
  Synthetic Construct
gcagtcgcttctccaccatgt

SEQ ID NO: 32285 - DNA, 28 bp, Artificial Sequence
  Synthetic Construct
gctcagtctaaaacaatagcctcccata

SEQ ID NO: 32286 - DNA, 23 bp, Artificial Sequence
  Synthetic Construct
gctacaagccactgttacgtttc

SEQ ID NO: 32287 - DNA, 25 bp, Artificial Sequence
  Synthetic Construct
actgaaggaatgtggtcatgaaaga

SEQ ID NO: 32288 - DNA, 22 bp, Artificial Sequence
  Synthetic Construct
agggtgggagtgcaacactaac

SEQ ID NO: 32289 - DNA, 20 bp, Artificial Sequence
  Synthetic Construct
gcagccaagcaggctattca

SEQ ID NO: 32290 - DNA, 23 bp, Artificial Sequence
  Synthetic Construct
ggcccttttcctctgagtcacta

SEQ ID NO: 32291 - DNA, 22 bp, Artificial Sequence
  Synthetic Construct
gcacatgctctttgcaggacaa

SEQ ID NO: 32292 - DNA, 24 bp, Artificial Sequence
  Synthetic Construct
cactgaggtaataaccagcagaca

SEQ ID NO: 32293 - DNA, 23 bp, Artificial Sequence
  Synthetic Construct
tcaggaggggagtggtggagtat

SEQ ID NO: 32294 - DNA, 24 bp, Artificial Sequence
  Synthetic Construct
ttttctgctgctcataggggatag

SEQ ID NO: 32295 - DNA, 20 bp, Artificial Sequence
  Synthetic Construct
aagccctccctctccagcaa

SEQ ID NO: 32296 - DNA, 26 bp, Artificial Sequence
  Synthetic Construct
ccatccttctttcaaagtggcagata

SEQ ID NO: 32297 - DNA, 27 bp, Artificial Sequence
  Synthetic Construct
gtcttgctcttactaccttgttgaact

SEQ ID NO: 32298 - DNA, 25 bp, Artificial Sequence
  Synthetic Construct
agccctagattagtgctgaaaatga

SEQ ID NO: 32299 - DNA, 22 bp, Artificial Sequence
  Synthetic Construct
agcagtgtggacagaggctaga

SEQ ID NO: 32300 - DNA, 28 bp, Artificial Sequence
  Synthetic Construct
cagtgcttagtgttcacactggagttat

SEQ ID NO: 32301 - DNA, 25 bp, Artificial Sequence
  Synthetic Construct
gtccctggaagcagctaatctaatg

SEQ ID NO: 32302 - DNA, 25 bp, Artificial Sequence
  Synthetic Construct
ctcagccatacaaagtgactgtctt

SEQ ID NO: 32303 - DNA, 20 bp, Artificial Sequence
  Synthetic Construct
gcccactgcacctctgtttg

SEQ ID NO: 32304 - DNA, 26 bp, Artificial Sequence
  Synthetic Construct
gtgaggatttattgagaggcgattgt

SEQ ID NO: 32305 - DNA, 22 bp, Artificial Sequence
  Synthetic Construct
gaccacgccacacttggtatga

SEQ ID NO: 32306 - DNA, 22 bp, Artificial Sequence
  Synthetic Construct
gctcctgagaagcaaacacaca

SEQ ID NO: 32307 - DNA, 27 bp, Artificial Sequence
  Synthetic Construct
ggaacaaaaatctgctgtctgcatttc

SEQ ID NO: 32308 - DNA, 27 bp, Artificial Sequence
  Synthetic Construct
gccaaatagagaactaacaggcacact

SEQ ID NO: 32309 - DNA, 21 bp, Artificial Sequence
  Synthetic Construct
ctcctgccctgagtctgaaac

SEQ ID NO: 32310 - DNA, 23 bp, Artificial Sequence
  Synthetic Construct
tgtgccagactcaatgctaaagt

SEQ ID NO: 32311 - DNA, 20 bp, Artificial Sequence
  Synthetic Construct
gcccatcacgcccttcagta

SEQ ID NO: 32312 - DNA, 22 bp, Artificial Sequence
  Synthetic Construct
gagggaagccgtgttctgattg

SEQ ID NO: 32313 - DNA, 21 bp, Artificial Sequence
  Synthetic Construct
gctgtccccttgtgaatgagt

SEQ ID NO: 32314 - DNA, 25 bp, Artificial Sequence
  Synthetic Construct
acatgtacactgggtcagaatttgt

SEQ ID NO: 32315 - DNA, 24 bp, Artificial Sequence
  Synthetic Construct
gctctccatgtttctgctgcttgt

SEQ ID NO: 32316 - DNA, 20 bp, Artificial Sequence
  Synthetic Construct
ctggttcttgggccttccaa

SEQ ID NO: 32317 - DNA, 25 bp, Artificial Sequence
  Synthetic Construct
ttcgtgggagagagaagttgataag

SEQ ID NO: 32318 - DNA, 22 bp, Artificial Sequence
  Synthetic Construct
tggaacaatagccacagcagtt

SEQ ID NO: 32319 - DNA, 20 bp, Artificial Sequence
  Synthetic Construct
ccagggccagagtagcaagt

SEQ ID NO: 32320 - DNA, 20 bp, Artificial Sequence
  Synthetic Construct
gcccacacgccatgtaaaga

SEQ ID NO: 32321 - DNA, 24 bp, Artificial Sequence
  Synthetic Construct
gtgtcccagaaaggaaatgagaca

SEQ ID NO: 32322 - DNA, 24 bp, Artificial Sequence
  Synthetic Construct
ggcacctgtcagatagggttggat

SEQ ID NO: 32323 - DNA, 24 bp, Artificial Sequence
  Synthetic Construct
ctggagtgaccctttggtgactta

SEQ ID NO: 32324 - DNA, 27 bp, Artificial Sequence
  Synthetic Construct
ggtcatgatgcatgggactaacaggta

SEQ ID NO: 32325 - DNA, 24 bp, Artificial Sequence
  Synthetic Construct
agtgacagggatcctttttcatgt

SEQ ID NO: 32326 - DNA, 24 bp, Artificial Sequence
  Synthetic Construct
ctggttgtggggaactatgtctca

SEQ ID NO: 32327 - DNA, 23 bp, Artificial Sequence
  Synthetic Construct
gtgttccatgccagacagacatc

SEQ ID NO: 32328 - DNA, 20 bp, Artificial Sequence
  Synthetic Construct
tctgggctccacactccaaa

SEQ ID NO: 32329 - DNA, 22 bp, Artificial Sequence
  Synthetic Construct
cagtttatcctgccagcccata

SEQ ID NO: 32330 - DNA, 27 bp, Artificial Sequence
  Synthetic Construct
gcctgcaaattaattatgggtcagcat

SEQ ID NO: 32331 - DNA, 25 bp, Artificial Sequence
  Synthetic Construct
ccgtagcctacagagtgttgtcatc

SEQ ID NO: 32332 - DNA, 22 bp, Artificial Sequence
  Synthetic Construct
tgacaaaccaagcacgttcagt

SEQ ID NO: 32333 - DNA, 22 bp, Artificial Sequence
  Synthetic Construct
ggggaagggaggtgagttaaag

SEQ ID NO: 32334 - DNA, 24 bp, Artificial Sequence
  Synthetic Construct
cctaggattatgctgccaacaact

SEQ ID NO: 32335 - DNA, 23 bp, Artificial Sequence
  Synthetic Construct
cccctgcttgtctgagttcatgt

SEQ ID NO: 32336 - DNA, 23 bp, Artificial Sequence
  Synthetic Construct
cgtcaatgccagaaggctagaag

SEQ ID NO: 32337 - DNA, 20 bp, Artificial Sequence
  Synthetic Construct
catggctggcacctttctgt

SEQ ID NO: 32338 - DNA, 22 bp, Artificial Sequence
  Synthetic Construct
cggcagtgtgaaaatggactga

SEQ ID NO: 32339 - DNA, 19 bp, Artificial Sequence
  Synthetic Construct
gccagcctggaccacatca

SEQ ID NO: 32340 - DNA, 27 bp, Artificial Sequence
  Synthetic Construct
ggatgggttttgagagcactaattttg

SEQ ID NO: 32341 - DNA, 20 bp, Artificial Sequence
  Synthetic Construct
cccaggcacaggcagaattg

SEQ ID NO: 32342 - DNA, 24 bp, Artificial Sequence
  Synthetic Construct
agtcttgtaacggacagacctcta

SEQ ID NO: 32343 - DNA, 22 bp, Artificial Sequence
  Synthetic Construct
ctcctgtttcagccccttctac

SEQ ID NO: 32344 - DNA, 22 bp, Artificial Sequence
  Synthetic Construct
ggtgaaccgtaggcaactgaac

SEQ ID NO: 32345 - DNA, 25 bp, Artificial Sequence
  Synthetic Construct
gctaattttaaaagccagccgaact

SEQ ID NO: 32346 - DNA, 27 bp, Artificial Sequence
  Synthetic Construct
ggaaggaaaaacttctccctgaggtat

SEQ ID NO: 32347 - DNA, 22 bp, Artificial Sequence
  Synthetic Construct
ggttcggtctggggagagattg

SEQ ID NO: 32348 - DNA, 25 bp, Artificial Sequence
  Synthetic Construct
cggtggcccagaggaatgaaatagt

SEQ ID NO: 32349 - DNA, 29 bp, Artificial Sequence
  Synthetic Construct
ggtgttagaaagagttcaaggcacttttg

SEQ ID NO: 32350 - DNA, 22 bp, Artificial Sequence
  Synthetic Construct
cctcttgagctgggtcttggaa

SEQ ID NO: 32351 - DNA, 23 bp, Artificial Sequence
  Synthetic Construct
gcacgtgcttactctctgtgctt

SEQ ID NO: 32352 - DNA, 22 bp, Artificial Sequence
  Synthetic Construct
tccccggggtgtcatttcttga

SEQ ID NO: 32353 - DNA, 24 bp, Artificial Sequence
  Synthetic Construct
ctcctttcctggtcccaattctgt

SEQ ID NO: 32354 - DNA, 23 bp, Artificial Sequence
  Synthetic Construct
gcctccatagcagtctgtgaatc

SEQ ID NO: 32355 - DNA, 25 bp, Artificial Sequence
  Synthetic Construct
ctccaatgcaggacaggaaaacatc

SEQ ID NO: 32356 - DNA, 23 bp, Artificial Sequence
  Synthetic Construct
caacatatggcatgcctgagaac

SEQ ID NO: 32357 - DNA, 25 bp, Artificial Sequence
  Synthetic Construct
cgtgtgtcagcaacttaacactttg

SEQ ID NO: 32358 - DNA, 26 bp, Artificial Sequence
  Synthetic Construct
ctgttgacaaatactctctccaccta

SEQ ID NO: 32359 - DNA, 25 bp, Artificial Sequence
  Synthetic Construct
actgagaaccagttgatgagagagt

SEQ ID NO: 32360 - DNA, 23 bp, Artificial Sequence
  Synthetic Construct
gggaagaaccagaatcactggaa

SEQ ID NO: 32361 - DNA, 18 bp, Artificial Sequence
  Synthetic Construct
tggggcgatagcgagtct

SEQ ID NO: 32362 - DNA, 23 bp, Artificial Sequence
  Synthetic Construct
gctggtgtattccctggacagaa

SEQ ID NO: 32363 - DNA, 21 bp, Artificial Sequence
  Synthetic Construct
gcgggtagtggtggtgttttc

SEQ ID NO: 32364 - DNA, 22 bp, Artificial Sequence
  Synthetic Construct
cagcactgagaaacccgctctt

SEQ ID NO: 32365 - DNA, 23 bp, Artificial Sequence
  Synthetic Construct
gcaccacacatggagaggagaag

SEQ ID NO: 32366 - DNA, 23 bp, Artificial Sequence
  Synthetic Construct
gtccagcctaaaggtttctctgt

SEQ ID NO: 32367 - DNA, 26 bp, Artificial Sequence
  Synthetic Construct
ctgacaaccatctaactgggaacaca

SEQ ID NO: 32368 - DNA, 21 bp, Artificial Sequence
  Synthetic Construct
ggccatgcaggctgacagatt

SEQ ID NO: 32369 - DNA, 26 bp, Artificial Sequence
  Synthetic Construct
gtacccatttgtgagtgtgaatgaag

SEQ ID NO: 32370 - DNA, 22 bp, Artificial Sequence
  Synthetic Construct
caggaaccagaatagcggtgat

SEQ ID NO: 32371 - DNA, 22 bp, Artificial Sequence
  Synthetic Construct
ccatggatggtgtggacaatga

SEQ ID NO: 32372 - DNA, 30 bp, Artificial Sequence
  Synthetic Construct
cagctcatacagatacgtggttatatcttg

SEQ ID NO: 32373 - DNA, 22 bp, Artificial Sequence
  Synthetic Construct
agacatagggtgtgacgtgtct

SEQ ID NO: 32374 - DNA, 22 bp, Artificial Sequence
  Synthetic Construct
tcagtgaggtggtgatggaaga

SEQ ID NO: 32375 - DNA, 22 bp, Artificial Sequence
  Synthetic Construct
tgtgctctcacttgtcaccatt

SEQ ID NO: 32376 - DNA, 19 bp, Artificial Sequence
  Synthetic Construct
ccaggtggagccacacgaa

SEQ ID NO: 32377 - DNA, 22 bp, Artificial Sequence
  Synthetic Construct
tctcctgtgctgtttcctttgt

SEQ ID NO: 32378 - DNA, 26 bp, Artificial Sequence
  Synthetic Construct
ccagtgaaatttttctgcctccaaga

SEQ ID NO: 32379 - DNA, 29 bp, Artificial Sequence
  Synthetic Construct
gactgggtacagatgtgatattggaagaa

SEQ ID NO: 32380 - DNA, 19 bp, Artificial Sequence
  Synthetic Construct
agcggggaagctccagtca

SEQ ID NO: 32381 - DNA, 21 bp, Artificial Sequence
  Synthetic Construct
gccccttgggcttcagtatgt

SEQ ID NO: 32382 - DNA, 21 bp, Artificial Sequence
  Synthetic Construct
gctgagctcccaaccatgtga

SEQ ID NO: 32383 - DNA, 22 bp, Artificial Sequence
  Synthetic Construct
tctgaaacctgtcaggggactt

SEQ ID NO: 32384 - DNA, 24 bp, Artificial Sequence
  Synthetic Construct
gacagggcagagtgaaaggtattc

SEQ ID NO: 32385 - DNA, 24 bp, Artificial Sequence
  Synthetic Construct
tgccttttgctatatgagctggat

SEQ ID NO: 32386 - DNA, 30 bp, Artificial Sequence
  Synthetic Construct
gcttaccaggtgtataataccttgagttct

SEQ ID NO: 32387 - DNA, 24 bp, Artificial Sequence
  Synthetic Construct
gctaggcacgatgagtagtgactt

SEQ ID NO: 32388 - DNA, 22 bp, Artificial Sequence
  Synthetic Construct
tcctttgctgtgagctgttgta

SEQ ID NO: 32389 - DNA, 30 bp, Artificial Sequence
  Synthetic Construct
ggctgtcacaaattatatcccaatcccttt

SEQ ID NO: 32390 - DNA, 21 bp, Artificial Sequence
  Synthetic Construct
gcatggaaagcagggctttag

SEQ ID NO: 32391 - DNA, 21 bp, Artificial Sequence
  Synthetic Construct
agacaagtgacggaggtctca

SEQ ID NO: 32392 - DNA, 28 bp, Artificial Sequence
  Synthetic Construct
caaatgtcttccctctatcctgatgttg

SEQ ID NO: 32393 - DNA, 24 bp, Artificial Sequence
  Synthetic Construct
cctaggtagtcacagaggcagttc

SEQ ID NO: 32394 - DNA, 26 bp, Artificial Sequence
  Synthetic Construct
cagtgagagaagggaaagagagctta

SEQ ID NO: 32395 - DNA, 23 bp, Artificial Sequence
  Synthetic Construct
tctttgagctggaggctatgttg

SEQ ID NO: 32396 - DNA, 25 bp, Artificial Sequence
  Synthetic Construct
acctcctctagctcatgaagaacaa

SEQ ID NO: 32397 - DNA, 23 bp, Artificial Sequence
  Synthetic Construct
ggtgtactccagcaatggacaga

SEQ ID NO: 32398 - DNA, 27 bp, Artificial Sequence
  Synthetic Construct
ggatgggtccatacttgtcattaggtt

SEQ ID NO: 32399 - DNA, 21 bp, Artificial Sequence
  Synthetic Construct
cccatgtgcttctggtcttct

SEQ ID NO: 32400 - DNA, 23 bp, Artificial Sequence
  Synthetic Construct
ggtgatcactgacggggtaaaac

SEQ ID NO: 32401 - DNA, 25 bp, Artificial Sequence
  Synthetic Construct
ggaagatgaactgagggagctgcta

SEQ ID NO: 32402 - DNA, 19 bp, Artificial Sequence
  Synthetic Construct
cgtggccagcgttccacat

SEQ ID NO: 32403 - DNA, 24 bp, Artificial Sequence
  Synthetic Construct
acctcccatcattcagcagtttag

SEQ ID NO: 32404 - DNA, 26 bp, Artificial Sequence
  Synthetic Construct
gtcctgagaataggccaatccaatta

SEQ ID NO: 32405 - DNA, 24 bp, Artificial Sequence
  Synthetic Construct
acaatgtcccaccttctgatttgt

SEQ ID NO: 32406 - DNA, 22 bp, Artificial Sequence
  Synthetic Construct
gggtaaacatgcccctggtcaa

SEQ ID NO: 32407 - DNA, 25 bp, Artificial Sequence
  Synthetic Construct
aaaagaacaaagtggatgccagtag

SEQ ID NO: 32408 - DNA, 21 bp, Artificial Sequence
  Synthetic Construct
aggcagaccctctgagcactt

SEQ ID NO: 32409 - DNA, 24 bp, Artificial Sequence
  Synthetic Construct
acagtggtactcggaatttgttgt

SEQ ID NO: 32410 - DNA, 26 bp, Artificial Sequence
  Synthetic Construct
aggatggctcaggttaatagagtagt

SEQ ID NO: 32411 - DNA, 21 bp, Artificial Sequence
  Synthetic Construct
tcctggccattgctcttttgt

SEQ ID NO: 32412 - DNA, 27 bp, Artificial Sequence
  Synthetic Construct
cccaactgagaaaggcttaccttctac

SEQ ID NO: 32413 - DNA, 23 bp, Artificial Sequence
  Synthetic Construct
aaggaaggtgaggaaagggaaag

SEQ ID NO: 32414 - DNA, 27 bp, Artificial Sequence
  Synthetic Construct
agataacgaggacagagcttatcttac

SEQ ID NO: 32415 - DNA, 25 bp, Artificial Sequence
  Synthetic Construct
tctattgactctaggtgctgtccta

SEQ ID NO: 32416 - DNA, 22 bp, Artificial Sequence
  Synthetic Construct
gtctccagtcagcctccaatgt

SEQ ID NO: 32417 - DNA, 22 bp, Artificial Sequence
  Synthetic Construct
gggaatacaaccactgctctca

SEQ ID NO: 32418 - DNA, 25 bp, Artificial Sequence
  Synthetic Construct
tgacctcagacagtttgcttttaac

SEQ ID NO: 32419 - DNA, 21 bp, Artificial Sequence
  Synthetic Construct
agcgagaccctctgctcagta

SEQ ID NO: 32420 - DNA, 27 bp, Artificial Sequence
  Synthetic Construct
aggatcctactggagatcaatcagaaa

SEQ ID NO: 32421 - DNA, 25 bp, Artificial Sequence
  Synthetic Construct
cctcctttttgtctctgtcccatag

SEQ ID NO: 32422 - DNA, 22 bp, Artificial Sequence
  Synthetic Construct
gctccacacaggttgaggagat

SEQ ID NO: 32423 - DNA, 24 bp, Artificial Sequence
  Synthetic Construct
gtggctctgatccctgtcactaag

SEQ ID NO: 32424 - DNA, 23 bp, Artificial Sequence
  Synthetic Construct
ctccttggcacctttgagctact

SEQ ID NO: 32425 - DNA, 26 bp, Artificial Sequence
  Synthetic Construct
gaatttcaggctaagggaagatgtgt

SEQ ID NO: 32426 - DNA, 22 bp, Artificial Sequence
  Synthetic Construct
caggtccctggtgtcttggttt

SEQ ID NO: 32427 - DNA, 21 bp, Artificial Sequence
  Synthetic Construct
gccagaggtaggggtggaagt

SEQ ID NO: 32428 - DNA, 23 bp, Artificial Sequence
  Synthetic Construct
cggattgacaaaacacgcagtga

SEQ ID NO: 32429 - DNA, 27 bp, Artificial Sequence
  Synthetic Construct
ccataactttcttcaagcaccactttg

SEQ ID NO: 32430 - DNA, 23 bp, Artificial Sequence
  Synthetic Construct
ggggcatgtgggactttagttct

SEQ ID NO: 32431 - DNA, 24 bp, Artificial Sequence
  Synthetic Construct
ggcttcttgacctccatgggaatg

SEQ ID NO: 32432 - DNA, 25 bp, Artificial Sequence
  Synthetic Construct
aatgatgtacctactgcactctgtt

SEQ ID NO: 32433 - DNA, 21 bp, Artificial Sequence
  Synthetic Construct
acaggagccctgatagccata

SEQ ID NO: 32434 - DNA, 25 bp, Artificial Sequence
  Synthetic Construct
aacctgtagctagtgctttatgtca

SEQ ID NO: 32435 - DNA, 23 bp, Artificial Sequence
  Synthetic Construct
gttttgcaacaaagctccactct

SEQ ID NO: 32436 - DNA, 24 bp, Artificial Sequence
  Synthetic Construct
tcaagttaaggagtggctttgagt

SEQ ID NO: 32437 - DNA, 23 bp, Artificial Sequence
  Synthetic Construct
gagggaaagccctaagccaagat

SEQ ID NO: 32438 - DNA, 24 bp, Artificial Sequence
  Synthetic Construct
cccctgagggtaagtggtacctaa

SEQ ID NO: 32439 - DNA, 22 bp, Artificial Sequence
  Synthetic Construct
tgtccagcaggggactgagtat

SEQ ID NO: 32440 - DNA, 22 bp, Artificial Sequence
  Synthetic Construct
aacacccttcaagcttcccaat

SEQ ID NO: 32441 - DNA, 22 bp, Artificial Sequence
  Synthetic Construct
gcggtactgatgctgctctgtt

SEQ ID NO: 32442 - DNA, 19 bp, Artificial Sequence
  Synthetic Construct
aagccggtggacgtgtctt

SEQ ID NO: 32443 - DNA, 21 bp, Artificial Sequence
  Synthetic Construct
ccaagtgctggacccaaatct

SEQ ID NO: 32444 - DNA, 19 bp, Artificial Sequence
  Synthetic Construct
tggcgggcataggtacaca

SEQ ID NO: 32445 - DNA, 25 bp, Artificial Sequence
  Synthetic Construct
gcagctagcaggagtagaaaaattg

SEQ ID NO: 32446 - DNA, 25 bp, Artificial Sequence
  Synthetic Construct
gggtgctgttcaataaagctgtgta

SEQ ID NO: 32447 - DNA, 28 bp, Artificial Sequence
  Synthetic Construct
gctgtgattcaaattcagttgggtctgt

SEQ ID NO: 32448 - DNA, 23 bp, Artificial Sequence
  Synthetic Construct
cccaggatggagaggggatgaat

SEQ ID NO: 32449 - DNA, 27 bp, Artificial Sequence
  Synthetic Construct
ctttagatagtacctccaaaggctgat

SEQ ID NO: 32450 - DNA, 22 bp, Artificial Sequence
  Synthetic Construct
ccccatagctcctggtgtcact

SEQ ID NO: 32451 - DNA, 23 bp, Artificial Sequence
  Synthetic Construct
ctcaaagcatgcagcctagatga

SEQ ID NO: 32452 - DNA, 20 bp, Artificial Sequence
  Synthetic Construct
ccctgctctccaaggtccta

SEQ ID NO: 32453 - DNA, 28 bp, Artificial Sequence
  Synthetic Construct
gtctctgctaagaaagatggaacgatga

SEQ ID NO: 32454 - DNA, 20 bp, Artificial Sequence
  Synthetic Construct
tcaggcccagagaggcatta

SEQ ID NO: 32455 - DNA, 27 bp, Artificial Sequence
  Synthetic Construct
gcatttttctggagagcaagtctattg

SEQ ID NO: 32456 - DNA, 22 bp, Artificial Sequence
  Synthetic Construct
ctctttagcaggcccagtttct

SEQ ID NO: 32457 - DNA, 25 bp, Artificial Sequence
  Synthetic Construct
ctgagatgtgttagcgtcattgctt

SEQ ID NO: 32458 - DNA, 21 bp, Artificial Sequence
  Synthetic Construct
ctgtcacttgtcagcgtggat

SEQ ID NO: 32459 - DNA, 25 bp, Artificial Sequence
  Synthetic Construct
ctctttcctatcgaggtgggtttca

SEQ ID NO: 32460 - DNA, 23 bp, Artificial Sequence
  Synthetic Construct
acacctggtcaggtcgtaatagt

SEQ ID NO: 32461 - DNA, 22 bp, Artificial Sequence
  Synthetic Construct
caggggatctagaggcagcttt

SEQ ID NO: 32462 - DNA, 25 bp, Artificial Sequence
  Synthetic Construct
ccttacaaggtgtgtctgtgcttct

SEQ ID NO: 32463 - DNA, 27 bp, Artificial Sequence
  Synthetic Construct
gctttgttaagcacttgtctgttgaga

SEQ ID NO: 32464 - DNA, 25 bp, Artificial Sequence
  Synthetic Construct
gtccaggataaggaggtggtggtat

SEQ ID NO: 32465 - DNA, 30 bp, Artificial Sequence
  Synthetic Construct
cctgtcaattatgaaaactgggccttttgt

SEQ ID NO: 32466 - DNA, 28 bp, Artificial Sequence
  Synthetic Construct
gaggtgaatgatgaggagatacagagat

SEQ ID NO: 32467 - DNA, 27 bp, Artificial Sequence
  Synthetic Construct
gatgacaagggtacagaaagatcaact

SEQ ID NO: 32468 - DNA, 25 bp, Artificial Sequence
  Synthetic Construct
acctgactgcactaactagactctt

SEQ ID NO: 32469 - DNA, 20 bp, Artificial Sequence
  Synthetic Construct
ggggcagtgtacaggcaaat

SEQ ID NO: 32470 - DNA, 20 bp, Artificial Sequence
  Synthetic Construct
ggccaggctgagtttcttct

SEQ ID NO: 32471 - DNA, 26 bp, Artificial Sequence
  Synthetic Construct
gtgcagcacacagaaaatacatcact

SEQ ID NO: 32472 - DNA, 24 bp, Artificial Sequence
  Synthetic Construct
ggctttgcaacctgctaattccta

SEQ ID NO: 32473 - DNA, 26 bp, Artificial Sequence
  Synthetic Construct
cacgataatgccacttaggtatgatg

SEQ ID NO: 32474 - DNA, 22 bp, Artificial Sequence
  Synthetic Construct
ccccacagcctagggtaatgaa

SEQ ID NO: 32475 - DNA, 28 bp, Artificial Sequence
  Synthetic Construct
gtgccaaagaaatggctaggtaatgttg

SEQ ID NO: 32476 - DNA, 24 bp, Artificial Sequence
  Synthetic Construct
gacatggtgaagtgcctcctaaca

SEQ ID NO: 32477 - DNA, 22 bp, Artificial Sequence
  Synthetic Construct
actgattcatgtgccacccatt

SEQ ID NO: 32478 - DNA, 24 bp, Artificial Sequence
  Synthetic Construct
tgctctgcacatttttcactctga

SEQ ID NO: 32479 - DNA, 23 bp, Artificial Sequence
  Synthetic Construct
tggtgtagctgggaaaactgaag

SEQ ID NO: 32480 - DNA, 20 bp, Artificial Sequence
  Synthetic Construct
tggtcaggcagtgtggaact

SEQ ID NO: 32481 - DNA, 22 bp, Artificial Sequence
  Synthetic Construct
tcctcaggggagtgggttttga

SEQ ID NO: 32482 - DNA, 27 bp, Artificial Sequence
  Synthetic Construct
gagtaatctgagagctcaaggagtcaa

SEQ ID NO: 32483 - DNA, 24 bp, Artificial Sequence
  Synthetic Construct
ctgaagggtctgtgccttggtaag

SEQ ID NO: 32484 - DNA, 25 bp, Artificial Sequence
  Synthetic Construct
tctctcatctcttgagtgtggaatg

SEQ ID NO: 32485 - DNA, 24 bp, Artificial Sequence
  Synthetic Construct
ctgtgcaaccttcatgctcacaac

SEQ ID NO: 32486 - DNA, 21 bp, Artificial Sequence
  Synthetic Construct
cggctcacccctagcttcttg

SEQ ID NO: 32487 - DNA, 21 bp, Artificial Sequence
  Synthetic Construct
gctgacgggcagagttgttca

SEQ ID NO: 32488 - DNA, 21 bp, Artificial Sequence
  Synthetic Construct
aggctggctcttggtctcaac

SEQ ID NO: 32489 - DNA, 25 bp, Artificial Sequence
  Synthetic Construct
gcacagttagatttaaggcgtgaac

SEQ ID NO: 32490 - DNA, 24 bp, Artificial Sequence
  Synthetic Construct
atgagcaaggagaggatttagcaa

SEQ ID NO: 32491 - DNA, 22 bp, Artificial Sequence
  Synthetic Construct
cactgaagcagtcaggttggtt

SEQ ID NO: 32492 - DNA, 21 bp, Artificial Sequence
  Synthetic Construct
tgtggacactgggacctctct

SEQ ID NO: 32493 - DNA, 22 bp, Artificial Sequence
  Synthetic Construct
gacccatctgtgaaggatgcaa

SEQ ID NO: 32494 - DNA, 23 bp, Artificial Sequence
  Synthetic Construct
ggatgcttgagggaaaactggat

SEQ ID NO: 32495 - DNA, 24 bp, Artificial Sequence
  Synthetic Construct
tttcctgtgcttacttctgtgcta

SEQ ID NO: 32496 - DNA, 23 bp, Artificial Sequence
  Synthetic Construct
tgtaaccttctgggattggcttt

SEQ ID NO: 32497 - DNA, 21 bp, Artificial Sequence
  Synthetic Construct
ggaaacgcagctagccttaga

SEQ ID NO: 32498 - DNA, 21 bp, Artificial Sequence
  Synthetic Construct
agcccaggtcaccaagagact

SEQ ID NO: 32499 - DNA, 21 bp, Artificial Sequence
  Synthetic Construct
ggaagcaaggcccacacatca

SEQ ID NO: 32500 - DNA, 21 bp, Artificial Sequence
  Synthetic Construct
ccctccccagctgacaatcat

SEQ ID NO: 32501 - DNA, 30 bp, Artificial Sequence
  Synthetic Construct
gcccatttattctctgcctaaaacaacaag

SEQ ID NO: 32502 - DNA, 24 bp, Artificial Sequence
  Synthetic Construct
attcccctaaaccatccaggattc

SEQ ID NO: 32503 - DNA, 25 bp, Artificial Sequence
  Synthetic Construct
gcaaatacctgtgtagccagcatca

SEQ ID NO: 32504 - DNA, 20 bp, Artificial Sequence
  Synthetic Construct
agcaggccagtaggcagaga

SEQ ID NO: 32505 - DNA, 26 bp, Artificial Sequence
  Synthetic Construct
gggaaaactcttcctaagcttcagtt

SEQ ID NO: 32506 - DNA, 24 bp, Artificial Sequence
  Synthetic Construct
ttccctttcagtgtaaacctgtgt

SEQ ID NO: 32507 - DNA, 22 bp, Artificial Sequence
  Synthetic Construct
gaagtaccagcggtgcattttc

SEQ ID NO: 32508 - DNA, 22 bp, Artificial Sequence
  Synthetic Construct
ctcacccagggattcaatgaca

SEQ ID NO: 32509 - DNA, 21 bp, Artificial Sequence
  Synthetic Construct
gcagctctgctggatgaaaac

SEQ ID NO: 32510 - DNA, 25 bp, Artificial Sequence
  Synthetic Construct
acaggttgtttgtgatacagcttct

SEQ ID NO: 32511 - DNA, 22 bp, Artificial Sequence
  Synthetic Construct
ccatggcataggcatgcaggat

SEQ ID NO: 32512 - DNA, 25 bp, Artificial Sequence
  Synthetic Construct
gcttggacagcttgattctgaagtt

SEQ ID NO: 32513 - DNA, 19 bp, Artificial Sequence
  Synthetic Construct
agccccagaggccctaaag

SEQ ID NO: 32514 - DNA, 22 bp, Artificial Sequence
  Synthetic Construct
tgctatgcctccctctggtagt

SEQ ID NO: 32515 - DNA, 27 bp, Artificial Sequence
  Synthetic Construct
gatgactgtctttcctccgtaataaac

SEQ ID NO: 32516 - DNA, 26 bp, Artificial Sequence
  Synthetic Construct
cagatgaagaaccgtagactccaact

SEQ ID NO: 32517 - DNA, 19 bp, Artificial Sequence
  Synthetic Construct
gcaggagcccgtgcatttg

SEQ ID NO: 32518 - DNA, 24 bp, Artificial Sequence
  Synthetic Construct
ggggcaggaatgggaatcaaggta

SEQ ID NO: 32519 - DNA, 20 bp, Artificial Sequence
  Synthetic Construct
ttaggggcccatggctcaca

SEQ ID NO: 32520 - DNA, 28 bp, Artificial Sequence
  Synthetic Construct
cccttattacatgcctccagatactttc

SEQ ID NO: 32521 - DNA, 24 bp, Artificial Sequence
  Synthetic Construct
acaggaagtaagggagcaaagatg

SEQ ID NO: 32522 - DNA, 25 bp, Artificial Sequence
  Synthetic Construct
cagccaccacaaatacacttagaac

SEQ ID NO: 32523 - DNA, 22 bp, Artificial Sequence
  Synthetic Construct
gactctcactgtggcaagaaca

SEQ ID NO: 32524 - DNA, 23 bp, Artificial Sequence
  Synthetic Construct
cagagggctcctccaactggata

SEQ ID NO: 32525 - DNA, 25 bp, Artificial Sequence
  Synthetic Construct
acaaagatgcagaagtctcacacaa

SEQ ID NO: 32526 - DNA, 22 bp, Artificial Sequence
  Synthetic Construct
ccagtgaagtgggtgctactct

SEQ ID NO: 32527 - DNA, 27 bp, Artificial Sequence
  Synthetic Construct
cacttttgcctctatcttttccaggtt

SEQ ID NO: 32528 - DNA, 25 bp, Artificial Sequence
  Synthetic Construct
gtgtggccaaatgaaatcaaacaca

SEQ ID NO: 32529 - DNA, 28 bp, Artificial Sequence
  Synthetic Construct
ggaagaattgatcactgacacagtggaa

SEQ ID NO: 32530 - DNA, 20 bp, Artificial Sequence
  Synthetic Construct
gcaagggccaagaagtgaca

SEQ ID NO: 32531 - DNA, 25 bp, Artificial Sequence
  Synthetic Construct
caccttttaattgcctggactggta

SEQ ID NO: 32532 - DNA, 24 bp, Artificial Sequence
  Synthetic Construct
gcatcctctcaaagcacaaagaca

SEQ ID NO: 32533 - DNA, 21 bp, Artificial Sequence
  Synthetic Construct
cgtgggtgagaagaacacact

SEQ ID NO: 32534 - DNA, 27 bp, Artificial Sequence
  Synthetic Construct
cctattatgcagccttcaactcctact

SEQ ID NO: 32535 - DNA, 21 bp, Artificial Sequence
  Synthetic Construct
acaaactgctgccctttccat

SEQ ID NO: 32536 - DNA, 25 bp, Artificial Sequence
  Synthetic Construct
caatgtgtggtgaccagttatccaa

SEQ ID NO: 32537 - DNA, 22 bp, Artificial Sequence
  Synthetic Construct
gccaactggccacatatcattg

SEQ ID NO: 32538 - DNA, 26 bp, Artificial Sequence
  Synthetic Construct
cctgacactggtactcaatcttctac

SEQ ID NO: 32539 - DNA, 22 bp, Artificial Sequence
  Synthetic Construct
gtttggcaggcataccgtaagt

SEQ ID NO: 32540 - DNA, 22 bp, Artificial Sequence
  Synthetic Construct
tctccacctccaccactcttag

SEQ ID NO: 32541 - DNA, 20 bp, Artificial Sequence
  Synthetic Construct
tcgagggcacaggcattcat

SEQ ID NO: 32542 - DNA, 24 bp, Artificial Sequence
  Synthetic Construct
ttatctgctccccacgtatgtaag

SEQ ID NO: 32543 - DNA, 21 bp, Artificial Sequence
  Synthetic Construct
agaagggagggccaggtgtaa

SEQ ID NO: 32544 - DNA, 24 bp, Artificial Sequence
  Synthetic Construct
gaggcaggaggatagtttgagttc

SEQ ID NO: 32545 - DNA, 22 bp, Artificial Sequence
  Synthetic Construct
gctggtaaggggcatccattca

SEQ ID NO: 32546 - DNA, 21 bp, Artificial Sequence
  Synthetic Construct
acccagaggagaaggttgagt

SEQ ID NO: 32547 - DNA, 25 bp, Artificial Sequence
  Synthetic Construct
tcctgaaggccagtatcttctaaac

SEQ ID NO: 32548 - DNA, 25 bp, Artificial Sequence
  Synthetic Construct
agctgtcaggcaaattacttactct

SEQ ID NO: 32549 - DNA, 26 bp, Artificial Sequence
  Synthetic Construct
gagatcagtgaagaaagtgaggttca

SEQ ID NO: 32550 - DNA, 25 bp, Artificial Sequence
  Synthetic Construct
tgcttcagaatgactcctcagtttc

SEQ ID NO: 32551 - DNA, 24 bp, Artificial Sequence
  Synthetic Construct
tccatggacaaggaaaacaaccaa

SEQ ID NO: 32552 - DNA, 24 bp, Artificial Sequence
  Synthetic Construct
agtctgcaaatatcgggagctttt

SEQ ID NO: 32553 - DNA, 26 bp, Artificial Sequence
  Synthetic Construct
ggaaactcaaaagcctttcaccagat

SEQ ID NO: 32554 - DNA, 26 bp, Artificial Sequence
  Synthetic Construct
gtgttactgactccaagagtgtgtct

SEQ ID NO: 32555 - DNA, 24 bp, Artificial Sequence
  Synthetic Construct
ccatcaatcccagttgcagccata

SEQ ID NO: 32556 - DNA, 25 bp, Artificial Sequence
  Synthetic Construct
caccattgagagggtagaggcattg

SEQ ID NO: 32557 - DNA, 24 bp, Artificial Sequence
  Synthetic Construct
ggggcagtacagacaccatctcta

SEQ ID NO: 32558 - DNA, 23 bp, Artificial Sequence
  Synthetic Construct
tcgggagggacactattcaatct

SEQ ID NO: 32559 - DNA, 21 bp, Artificial Sequence
  Synthetic Construct
gctgggcctgcagttccttta

SEQ ID NO: 32560 - DNA, 24 bp, Artificial Sequence
  Synthetic Construct
ggcagagcctggacatcctagaaa

SEQ ID NO: 32561 - DNA, 20 bp, Artificial Sequence
  Synthetic Construct
cacctgtgggcatgggacta

SEQ ID NO: 32562 - DNA, 21 bp, Artificial Sequence
  Synthetic Construct
cgacctctgcccttgttgtct

SEQ ID NO: 32563 - DNA, 22 bp, Artificial Sequence
  Synthetic Construct
gctgcaggcacagtgttagctt

SEQ ID NO: 32564 - DNA, 29 bp, Artificial Sequence
  Synthetic Construct
gggatttggtttgggatttgtggaatcaa

SEQ ID NO: 32565 - DNA, 24 bp, Artificial Sequence
  Synthetic Construct
tggatttagaagcgttgccatttc

SEQ ID NO: 32566 - DNA, 19 bp, Artificial Sequence
  Synthetic Construct
agccgcagcaggagataca

SEQ ID NO: 32567 - DNA, 27 bp, Artificial Sequence
  Synthetic Construct
cagattcacccaactcctctattctgt

SEQ ID NO: 32568 - DNA, 24 bp, Artificial Sequence
  Synthetic Construct
ctctgccagtgggaagtttgattg

SEQ ID NO: 32569 - DNA, 25 bp, Artificial Sequence
  Synthetic Construct
aaaccctgtattatgctgctgtaga

SEQ ID NO: 32570 - DNA, 23 bp, Artificial Sequence
  Synthetic Construct
gggaagctgaaactaggctaact

SEQ ID NO: 32571 - DNA, 25 bp, Artificial Sequence
  Synthetic Construct
cagctaaaccaactttgacaaggaa

SEQ ID NO: 32572 - DNA, 22 bp, Artificial Sequence
  Synthetic Construct
gggaaagatgggcatggctgaa

SEQ ID NO: 32573 - DNA, 23 bp, Artificial Sequence
  Synthetic Construct
tgatctttgagctggacctctct

SEQ ID NO: 32574 - DNA, 29 bp, Artificial Sequence
  Synthetic Construct
ctccatgtgcttttcctcatacacttaga

SEQ ID NO: 32575 - DNA, 20 bp, Artificial Sequence
  Synthetic Construct
gcagggaggcaaagatgact

SEQ ID NO: 32576 - DNA, 24 bp, Artificial Sequence
  Synthetic Construct
aggtggtgcctttaagctagaaaa

SEQ ID NO: 32577 - DNA, 22 bp, Artificial Sequence
  Synthetic Construct
ctcgagggctttccatcagcaa

SEQ ID NO: 32578 - DNA, 22 bp, Artificial Sequence
  Synthetic Construct
ggtcagttgggccaggtttcta

SEQ ID NO: 32579 - DNA, 21 bp, Artificial Sequence
  Synthetic Construct
gcccagcctagctgcatacaa

SEQ ID NO: 32580 - DNA, 25 bp, Artificial Sequence
  Synthetic Construct
aaggctgaatagtgggaagagttac

SEQ ID NO: 32581 - DNA, 24 bp, Artificial Sequence
  Synthetic Construct
acacacacgtaactagggaagatg

SEQ ID NO: 32582 - DNA, 25 bp, Artificial Sequence
  Synthetic Construct
aggtcttagatagcaaggaccatgt

SEQ ID NO: 32583 - DNA, 23 bp, Artificial Sequence
  Synthetic Construct
ctgactgtccagtgcagtttaga

SEQ ID NO: 32584 - DNA, 28 bp, Artificial Sequence
  Synthetic Construct
cacataggtggtatcatctcccttcaga

SEQ ID NO: 32585 - DNA, 25 bp, Artificial Sequence
  Synthetic Construct
acctaaccctcacattcatttgctt

SEQ ID NO: 32586 - DNA, 21 bp, Artificial Sequence
  Synthetic Construct
accctgaccacttgtgactct

SEQ ID NO: 32587 - DNA, 21 bp, Artificial Sequence
  Synthetic Construct
gtgcacgggagcaagaaaaac

SEQ ID NO: 32588 - DNA, 22 bp, Artificial Sequence
  Synthetic Construct
gctctggtgcacccttgactta

SEQ ID NO: 32589 - DNA, 21 bp, Artificial Sequence
  Synthetic Construct
acacgtgctgaaatccaggaa

SEQ ID NO: 32590 - DNA, 26 bp, Artificial Sequence
  Synthetic Construct
aggaagaccaggatacagacataaga

SEQ ID NO: 32591 - DNA, 21 bp, Artificial Sequence
  Synthetic Construct
tccttggcttgggacctcctt

SEQ ID NO: 32592 - DNA, 22 bp, Artificial Sequence
  Synthetic Construct
ccacactgagcacttgcctact

SEQ ID NO: 32593 - DNA, 22 bp, Artificial Sequence
  Synthetic Construct
gtgcttgctgcaattccccaaa

SEQ ID NO: 32594 - DNA, 23 bp, Artificial Sequence
  Synthetic Construct
tgttggatgccatgatgaagaga

SEQ ID NO: 32595 - DNA, 23 bp, Artificial Sequence
  Synthetic Construct
cctcagtccctgtcagttagtgt

SEQ ID NO: 32596 - DNA, 20 bp, Artificial Sequence
  Synthetic Construct
ggggctccgaacggaaaaac

SEQ ID NO: 32597 - DNA, 21 bp, Artificial Sequence
  Synthetic Construct
gccctcagagaggcactcaat

SEQ ID NO: 32598 - DNA, 22 bp, Artificial Sequence
  Synthetic Construct
tgagaaccaggagccagagaat

SEQ ID NO: 32599 - DNA, 20 bp, Artificial Sequence
  Synthetic Construct
gtccagagccaggagagaga

SEQ ID NO: 32600 - DNA, 27 bp, Artificial Sequence
  Synthetic Construct
ctcttcttctcagaattccaccctgaa

SEQ ID NO: 32601 - DNA, 22 bp, Artificial Sequence
  Synthetic Construct
agggcctcagacccattgaaca

SEQ ID NO: 32602 - DNA, 24 bp, Artificial Sequence
  Synthetic Construct
aggatttgttactgggctacacaa

SEQ ID NO: 32603 - DNA, 26 bp, Artificial Sequence
  Synthetic Construct
ccaacgctttcataaacggagttagt

SEQ ID NO: 32604 - DNA, 24 bp, Artificial Sequence
  Synthetic Construct
gaaggttgctttctgtgtttgaga

SEQ ID NO: 32605 - DNA, 27 bp, Artificial Sequence
  Synthetic Construct
gcaaagatgaaaactggaagctacaac

SEQ ID NO: 32606 - DNA, 23 bp, Artificial Sequence
  Synthetic Construct
tctcggagaccagagggagatac

SEQ ID NO: 32607 - DNA, 22 bp, Artificial Sequence
  Synthetic Construct
gaagctgaaagtggcagctagt

SEQ ID NO: 32608 - DNA, 25 bp, Artificial Sequence
  Synthetic Construct
tcttctgccttagcaattgaacagt

SEQ ID NO: 32609 - DNA, 25 bp, Artificial Sequence
  Synthetic Construct
tgctcttgtgtacatatgtctgctt

SEQ ID NO: 32610 - DNA, 29 bp, Artificial Sequence
  Synthetic Construct
caggaataaggatttggatctctggcttt

SEQ ID NO: 32611 - DNA, 22 bp, Artificial Sequence
  Synthetic Construct
cacatgacgtccctgtgtctgt

SEQ ID NO: 32612 - DNA, 25 bp, Artificial Sequence
  Synthetic Construct
tgaggctcaaagtgatacagctatt

SEQ ID NO: 32613 - DNA, 24 bp, Artificial Sequence
  Synthetic Construct
ctgctcgactcttcagtaggtgat

SEQ ID NO: 32614 - DNA, 25 bp, Artificial Sequence
  Synthetic Construct
cctgagtatgggagaaggggatttg

SEQ ID NO: 32615 - DNA, 22 bp, Artificial Sequence
  Synthetic Construct
ggcaacaagagcgaaactgcat

SEQ ID NO: 32616 - DNA, 20 bp, Artificial Sequence
  Synthetic Construct
ccacagctgccagtggtctt

SEQ ID NO: 32617 - DNA, 24 bp, Artificial Sequence
  Synthetic Construct
ccccagaagctgaccctgaagata

SEQ ID NO: 32618 - DNA, 21 bp, Artificial Sequence
  Synthetic Construct
tggccccactccatctctaag

SEQ ID NO: 32619 - DNA, 22 bp, Artificial Sequence
  Synthetic Construct
cctgagctacaggagtgagaca

SEQ ID NO: 32620 - DNA, 22 bp, Artificial Sequence
  Synthetic Construct
ccaagccgcgagtggttttatg

SEQ ID NO: 32621 - DNA, 19 bp, Artificial Sequence
  Synthetic Construct
ccaggagcgcagctacaga

SEQ ID NO: 32622 - DNA, 21 bp, Artificial Sequence
  Synthetic Construct
tgggagccaaagaacttgtgt

SEQ ID NO: 32623 - DNA, 21 bp, Artificial Sequence
  Synthetic Construct
acgctgtgctcaaacacttct

SEQ ID NO: 32624 - DNA, 23 bp, Artificial Sequence
  Synthetic Construct
tgggcaaacatgggagatgatag

SEQ ID NO: 32625 - DNA, 22 bp, Artificial Sequence
  Synthetic Construct
gatgtgctgagaagggttcaga

SEQ ID NO: 32626 - DNA, 22 bp, Artificial Sequence
  Synthetic Construct
aagaattcagctgccaggaaca

SEQ ID NO: 32627 - DNA, 25 bp, Artificial Sequence
  Synthetic Construct
gcttaaggccagaagtttgaaggtt

SEQ ID NO: 32628 - DNA, 20 bp, Artificial Sequence
  Synthetic Construct
gccatggccaggacaaaaac

SEQ ID NO: 32629 - DNA, 20 bp, Artificial Sequence
  Synthetic Construct
ggctcacccaaaccttggaa

SEQ ID NO: 32630 - DNA, 23 bp, Artificial Sequence
  Synthetic Construct
ccccgtcccacagtagtcttatc

SEQ ID NO: 32631 - DNA, 24 bp, Artificial Sequence
  Synthetic Construct
atggtctttgggttggcaaaatac

SEQ ID NO: 32632 - DNA, 29 bp, Artificial Sequence
  Synthetic Construct
ccataacaagagagactaaaggccgtatc

SEQ ID NO: 32633 - DNA, 21 bp, Artificial Sequence
  Synthetic Construct
gctgctggccccagtaacatt

SEQ ID NO: 32634 - DNA, 23 bp, Artificial Sequence
  Synthetic Construct
cttaggcagaaacttgcccaaag

SEQ ID NO: 32635 - DNA, 22 bp, Artificial Sequence
  Synthetic Construct
tggttgcaaatttggcagtgaa

SEQ ID NO: 32636 - DNA, 26 bp, Artificial Sequence
  Synthetic Construct
ggtaatcacccagccataaccaatca

SEQ ID NO: 32637 - DNA, 21 bp, Artificial Sequence
  Synthetic Construct
gcagctgcctctgagtgtttg

SEQ ID NO: 32638 - DNA, 25 bp, Artificial Sequence
  Synthetic Construct
aagtactgacaatacaggcaggttt

SEQ ID NO: 32639 - DNA, 21 bp, Artificial Sequence
  Synthetic Construct
gcagagggagcctctagtgta

SEQ ID NO: 32640 - DNA, 21 bp, Artificial Sequence
  Synthetic Construct
cccacagcactgctcaagatg

SEQ ID NO: 32641 - DNA, 22 bp, Artificial Sequence
  Synthetic Construct
actcctcgcagacatcagtctt

SEQ ID NO: 32642 - DNA, 26 bp, Artificial Sequence
  Synthetic Construct
gtccaaattttcctggcatgcttagt

SEQ ID NO: 32643 - DNA, 20 bp, Artificial Sequence
  Synthetic Construct
acctcctgcttccctgaaca

SEQ ID NO: 32644 - DNA, 20 bp, Artificial Sequence
  Synthetic Construct
catccgcagcactgagagaa

SEQ ID NO: 32645 - DNA, 24 bp, Artificial Sequence
  Synthetic Construct
cccattgtgggatgcacattgatt

SEQ ID NO: 32646 - DNA, 19 bp, Artificial Sequence
  Synthetic Construct
ccggctgagcacaccatct

SEQ ID NO: 32647 - DNA, 21 bp, Artificial Sequence
  Synthetic Construct
ttccagctgactgtcctcaga

SEQ ID NO: 32648 - DNA, 24 bp, Artificial Sequence
  Synthetic Construct
gatcagtgtggtggtgaattggat

SEQ ID NO: 32649 - DNA, 19 bp, Artificial Sequence
  Synthetic Construct
ggcagagtggggacacaca

SEQ ID NO: 32650 - DNA, 23 bp, Artificial Sequence
  Synthetic Construct
atgcaagggagcaatttgcatag

SEQ ID NO: 32651 - DNA, 28 bp, Artificial Sequence
  Synthetic Construct
cctgaaaacatgtagaggagctttgatg

SEQ ID NO: 32652 - DNA, 24 bp, Artificial Sequence
  Synthetic Construct
ccgaggccagacctgctacatatt

SEQ ID NO: 32653 - DNA, 21 bp, Artificial Sequence
  Synthetic Construct
gcaacgagctccttctgatga

SEQ ID NO: 32654 - DNA, 23 bp, Artificial Sequence
  Synthetic Construct
cctagctcagccacagtggaata

SEQ ID NO: 32655 - DNA, 22 bp, Artificial Sequence
  Synthetic Construct
ggagcaggggctcagaaaagtt

SEQ ID NO: 32656 - DNA, 27 bp, Artificial Sequence
  Synthetic Construct
ttcacatattagcctacactcctcttc

SEQ ID NO: 32657 - DNA, 23 bp, Artificial Sequence
  Synthetic Construct
agtttcttggaccccagacattc

SEQ ID NO: 32658 - DNA, 20 bp, Artificial Sequence
  Synthetic Construct
acgcagctgagttccacgtt

SEQ ID NO: 32659 - DNA, 20 bp, Artificial Sequence
  Synthetic Construct
tgtcttggccccatctcctt

SEQ ID NO: 32660 - DNA, 25 bp, Artificial Sequence
  Synthetic Construct
gttcaccttcaagcaaaccctatac

SEQ ID NO: 32661 - DNA, 27 bp, Artificial Sequence
  Synthetic Construct
cccctttttggtctgtttatggcaagt

SEQ ID NO: 32662 - DNA, 25 bp, Artificial Sequence
  Synthetic Construct
gctcagcttatagtagccagagaaa

SEQ ID NO: 32663 - DNA, 22 bp, Artificial Sequence
  Synthetic Construct
ttgcagtgtcacctgggataag

SEQ ID NO: 32664 - DNA, 24 bp, Artificial Sequence
  Synthetic Construct
gcagagagaagcaactcagcttac

SEQ ID NO: 32665 - DNA, 22 bp, Artificial Sequence
  Synthetic Construct
gcagaccatagtggctgaggtt

SEQ ID NO: 32666 - DNA, 23 bp, Artificial Sequence
  Synthetic Construct
ggaggtggggcataaggtgattc

SEQ ID NO: 32667 - DNA, 21 bp, Artificial Sequence
  Synthetic Construct
gccagctgcaacaaccattag

SEQ ID NO: 32668 - DNA, 25 bp, Artificial Sequence
  Synthetic Construct
gcatctgagcaagtctccttcttgt

SEQ ID NO: 32669 - DNA, 20 bp, Artificial Sequence
  Synthetic Construct
gcagaggagctcagctgttt

SEQ ID NO: 32670 - DNA, 27 bp, Artificial Sequence
  Synthetic Construct
cggttttcagatttcaagacggtgtgt

SEQ ID NO: 32671 - DNA, 22 bp, Artificial Sequence
  Synthetic Construct
ggtgcaccgatgcagattctct

SEQ ID NO: 32672 - DNA, 23 bp, Artificial Sequence
  Synthetic Construct
agggacgtagaggggacaactac

SEQ ID NO: 32673 - DNA, 22 bp, Artificial Sequence
  Synthetic Construct
ccacttggaccagagagacgtt

SEQ ID NO: 32674 - DNA, 22 bp, Artificial Sequence
  Synthetic Construct
ccctagagcccaaaggcaacaa

SEQ ID NO: 32675 - DNA, 24 bp, Artificial Sequence
  Synthetic Construct
tgctcttctgctggaatttaccaa

SEQ ID NO: 32676 - DNA, 25 bp, Artificial Sequence
  Synthetic Construct
gcaggaattcagaggaattggactt

SEQ ID NO: 32677 - DNA, 24 bp, Artificial Sequence
  Synthetic Construct
tctctctgaatccacctgctctta

SEQ ID NO: 32678 - DNA, 25 bp, Artificial Sequence
  Synthetic Construct
tcggacaatcacctgaaatgaaaac

SEQ ID NO: 32679 - DNA, 26 bp, Artificial Sequence
  Synthetic Construct
gtcagaattaggcctctctcaaccta

SEQ ID NO: 32680 - DNA, 22 bp, Artificial Sequence
  Synthetic Construct
gtgtgggtgggtactgaaggaa

SEQ ID NO: 32681 - DNA, 22 bp, Artificial Sequence
  Synthetic Construct
ggtgttgaacgccattttcaca

SEQ ID NO: 32682 - DNA, 30 bp, Artificial Sequence
  Synthetic Construct
ccttttctcccattaatccatctgccttat

SEQ ID NO: 32683 - DNA, 25 bp, Artificial Sequence
  Synthetic Construct
ctttgtctgtctgcatctgacattt

SEQ ID NO: 32684 - DNA, 25 bp, Artificial Sequence
  Synthetic Construct
gagaagagcctgggctatatttcaa

SEQ ID NO: 32685 - DNA, 23 bp, Artificial Sequence
  Synthetic Construct
ggcttggcaaggtttcaggtttg

SEQ ID NO: 32686 - DNA, 20 bp, Artificial Sequence
  Synthetic Construct
atcgcgggcatctgtgtaac

SEQ ID NO: 32687 - DNA, 20 bp, Artificial Sequence
  Synthetic Construct
tcacagggttggcaggaact

SEQ ID NO: 32688 - DNA, 27 bp, Artificial Sequence
  Synthetic Construct
gaccatttcatgctcactgctttcttg

SEQ ID NO: 32689 - DNA, 19 bp, Artificial Sequence
  Synthetic Construct
agctgctgcagacccatgt

SEQ ID NO: 32690 - DNA, 20 bp, Artificial Sequence
  Synthetic Construct
tctggctcagcatggtcact

SEQ ID NO: 32691 - DNA, 21 bp, Artificial Sequence
  Synthetic Construct
ggcccctctgtaaaagtgcat

SEQ ID NO: 32692 - DNA, 19 bp, Artificial Sequence
  Synthetic Construct
agctgcgggcaaggtatca

SEQ ID NO: 32693 - DNA, 23 bp, Artificial Sequence
  Synthetic Construct
cctattgcacacggtcacaattt

SEQ ID NO: 32694 - DNA, 24 bp, Artificial Sequence
  Synthetic Construct
ccctactcccaactgcacttgaac

SEQ ID NO: 32695 - DNA, 22 bp, Artificial Sequence
  Synthetic Construct
ccccagacctgtgattcaccaa

SEQ ID NO: 32696 - DNA, 27 bp, Artificial Sequence
  Synthetic Construct
gcacaggagtaatacgatctgacatct

SEQ ID NO: 32697 - DNA, 21 bp, Artificial Sequence
  Synthetic Construct
cctgagggtgcacctgcttag

SEQ ID NO: 32698 - DNA, 25 bp, Artificial Sequence
  Synthetic Construct
gcaggcaataacgaatgagagttta

SEQ ID NO: 32699 - DNA, 21 bp, Artificial Sequence
  Synthetic Construct
gccagttccctctgggaggtt

SEQ ID NO: 32700 - DNA, 22 bp, Artificial Sequence
  Synthetic Construct
cctcttccctcaccgtgtttga

SEQ ID NO: 32701 - DNA, 25 bp, Artificial Sequence
  Synthetic Construct
ttctgagttccagagacactacaag

SEQ ID NO: 32702 - DNA, 20 bp, Artificial Sequence
  Synthetic Construct
acgcccagccccaactttta

SEQ ID NO: 32703 - DNA, 21 bp, Artificial Sequence
  Synthetic Construct
gctctcctccccaggaaccat

SEQ ID NO: 32704 - DNA, 24 bp, Artificial Sequence
  Synthetic Construct
cgctggagactggtctgagttcaa

SEQ ID NO: 32705 - DNA, 21 bp, Artificial Sequence
  Synthetic Construct
gggtgccaggacttcctctga

SEQ ID NO: 32706 - DNA, 21 bp, Artificial Sequence
  Synthetic Construct
acacgggacacgggagatgaa

SEQ ID NO: 32707 - DNA, 26 bp, Artificial Sequence
  Synthetic Construct
gtgtgacctattttaggaggcactgt

SEQ ID NO: 32708 - DNA, 21 bp, Artificial Sequence
  Synthetic Construct
gacccggtcaagttggtttca

SEQ ID NO: 32709 - DNA, 24 bp, Artificial Sequence
  Synthetic Construct
tcttgggaacagccactcttaaac

SEQ ID NO: 32710 - DNA, 25 bp, Artificial Sequence
  Synthetic Construct
gcttcatatccaaggggtctagatg

SEQ ID NO: 32711 - DNA, 27 bp, Artificial Sequence
  Synthetic Construct
gcacacactttgtttccatagcagttc

SEQ ID NO: 32712 - DNA, 20 bp, Artificial Sequence
  Synthetic Construct
ggcctcagcactggaagtct

SEQ ID NO: 32713 - DNA, 22 bp, Artificial Sequence
  Synthetic Construct
actcttggtcgaggagatcaca

SEQ ID NO: 32714 - DNA, 18 bp, Artificial Sequence
  Synthetic Construct
cctgccctcgcacaaaca

SEQ ID NO: 32715 - DNA, 23 bp, Artificial Sequence
  Synthetic Construct
ggcagaggcttggtggatagaag

SEQ ID NO: 32716 - DNA, 21 bp, Artificial Sequence
  Synthetic Construct
cccttcttccaagccaagtga

SEQ ID NO: 32717 - DNA, 22 bp, Artificial Sequence
  Synthetic Construct
gcatgttcctctcccctcttct

SEQ ID NO: 32718 - DNA, 22 bp, Artificial Sequence
  Synthetic Construct
ccgtgagaatgaaggtgctttg

SEQ ID NO: 32719 - DNA, 25 bp, Artificial Sequence
  Synthetic Construct
ccaggcattaacttagcgagtggat

SEQ ID NO: 32720 - DNA, 26 bp, Artificial Sequence
  Synthetic Construct
ctgagagggcctttagggaaagaatg

SEQ ID NO: 32721 - DNA, 29 bp, Artificial Sequence
  Synthetic Construct
gggtaaagttggaggaactatactacttg

SEQ ID NO: 32722 - DNA, 21 bp, Artificial Sequence
  Synthetic Construct
ggcaggctctgtggaagtcaa

SEQ ID NO: 32723 - DNA, 24 bp, Artificial Sequence
  Synthetic Construct
caggcctgattcattctcctgcaa

SEQ ID NO: 32724 - DNA, 23 bp, Artificial Sequence
  Synthetic Construct
ggggaaaagccctggccttatag

SEQ ID NO: 32725 - DNA, 20 bp, Artificial Sequence
  Synthetic Construct
aaactgtgggtcacgctgat

SEQ ID NO: 32726 - DNA, 22 bp, Artificial Sequence
  Synthetic Construct
gctccatggggaaggactctta

SEQ ID NO: 32727 - DNA, 20 bp, Artificial Sequence
  Synthetic Construct
ccacgtggaggggcattcta

SEQ ID NO: 32728 - DNA, 22 bp, Artificial Sequence
  Synthetic Construct
ccacccagaaggggttatccat

SEQ ID NO: 32729 - DNA, 28 bp, Artificial Sequence
  Synthetic Construct
ggtactggattcagttcagtctaacttc

SEQ ID NO: 32730 - DNA, 20 bp, Artificial Sequence
  Synthetic Construct
tgccaccgatgccagacaga

SEQ ID NO: 32731 - DNA, 21 bp, Artificial Sequence
  Synthetic Construct
gcagccaggtcacagagcatt

SEQ ID NO: 32732 - DNA, 21 bp, Artificial Sequence
  Synthetic Construct
ggcggaaagctaaaggcatgt

SEQ ID NO: 32733 - DNA, 25 bp, Artificial Sequence
  Synthetic Construct
gctctttggtgagctgaactctttt

SEQ ID NO: 32734 - DNA, 21 bp, Artificial Sequence
  Synthetic Construct
cttagcctgtggcactcaact

SEQ ID NO: 32735 - DNA, 22 bp, Artificial Sequence
  Synthetic Construct
ctgctgaccccttcacctgtat

SEQ ID NO: 32736 - DNA, 22 bp, Artificial Sequence
  Synthetic Construct
ctttaggggctggcacttttca

SEQ ID NO: 32737 - DNA, 23 bp, Artificial Sequence
  Synthetic Construct
cagctgttttgtgccgcaaagat

SEQ ID NO: 32738 - DNA, 21 bp, Artificial Sequence
  Synthetic Construct
gcccagccttgtaaagtggtt

SEQ ID NO: 32739 - DNA, 24 bp, Artificial Sequence
  Synthetic Construct
ggtggatgggctggtatacaaatg

SEQ ID NO: 32740 - DNA, 21 bp, Artificial Sequence
  Synthetic Construct
agtatactgcggggccatttc

SEQ ID NO: 32741 - DNA, 22 bp, Artificial Sequence
  Synthetic Construct
aaaaggttcgctctggatggat

SEQ ID NO: 32742 - DNA, 21 bp, Artificial Sequence
  Synthetic Construct
tttgaagccactgcagtctga

SEQ ID NO: 32743 - DNA, 23 bp, Artificial Sequence
  Synthetic Construct
ctcaacaagcactgcagttgtaa

SEQ ID NO: 32744 - DNA, 20 bp, Artificial Sequence
  Synthetic Construct
cggctgtgtttgctgcttgt

SEQ ID NO: 32745 - DNA, 24 bp, Artificial Sequence
  Synthetic Construct
agcagaagatccttaatggcagaa

SEQ ID NO: 32746 - DNA, 25 bp, Artificial Sequence
  Synthetic Construct
gctcagtgcatcccttctacctagt

SEQ ID NO: 32747 - DNA, 21 bp, Artificial Sequence
  Synthetic Construct
gctctgggctctgcaggattt

SEQ ID NO: 32748 - DNA, 26 bp, Artificial Sequence
  Synthetic Construct
ccacttgtcaagaacacgcaaggatt

SEQ ID NO: 32749 - DNA, 24 bp, Artificial Sequence
  Synthetic Construct
ggggacctattgctcacaggaaga

SEQ ID NO: 32750 - DNA, 25 bp, Artificial Sequence
  Synthetic Construct
gcaaaggaatcaagtggtgtcaagt

SEQ ID NO: 32751 - DNA, 18 bp, Artificial Sequence
  Synthetic Construct
tggcccggttcagactgt

SEQ ID NO: 32752 - DNA, 25 bp, Artificial Sequence
  Synthetic Construct
ccgaaaaatgaagttacaggggaaa

SEQ ID NO: 32753 - DNA, 27 bp, Artificial Sequence
  Synthetic Construct
gcgaaaattccttcttgccttccttag

SEQ ID NO: 32754 - DNA, 24 bp, Artificial Sequence
  Synthetic Construct
gcattccttggtgcaggctttaat

SEQ ID NO: 32755 - DNA, 20 bp, Artificial Sequence
  Synthetic Construct
ggttgcagtggaggagttca

SEQ ID NO: 32756 - DNA, 23 bp, Artificial Sequence
  Synthetic Construct
ccacacactcaacccacctaatg

SEQ ID NO: 32757 - DNA, 20 bp, Artificial Sequence
  Synthetic Construct
caccctgcagtccagtcaaa

SEQ ID NO: 32758 - DNA, 23 bp, Artificial Sequence
  Synthetic Construct
ggtctgctgtccagattcctact

SEQ ID NO: 32759 - DNA, 23 bp, Artificial Sequence
  Synthetic Construct
ccatgcccagtccatacttgctt

SEQ ID NO: 32760 - DNA, 24 bp, Artificial Sequence
  Synthetic Construct
cctctcttccgtctcctttccata

SEQ ID NO: 32761 - DNA, 23 bp, Artificial Sequence
  Synthetic Construct
ctgtggtagcttgtttcgtgcaa

SEQ ID NO: 32762 - DNA, 25 bp, Artificial Sequence
  Synthetic Construct
gctgtttcccagcagtatggaaatg

SEQ ID NO: 32763 - DNA, 30 bp, Artificial Sequence
  Synthetic Construct
gggccagaatctagtttaaggagagtttat

SEQ ID NO: 32764 - DNA, 18 bp, Artificial Sequence
  Synthetic Construct
aaggcagccagggcacta

SEQ ID NO: 32765 - DNA, 26 bp, Artificial Sequence
  Synthetic Construct
gagaaccgagactcacaacattaaga

SEQ ID NO: 32766 - DNA, 23 bp, Artificial Sequence
  Synthetic Construct
ctggccacattcaccaaccaaag

SEQ ID NO: 32767 - DNA, 21 bp, Artificial Sequence
  Synthetic Construct
aagccagctcagacaggattg

SEQ ID NO: 32768 - DNA, 21 bp, Artificial Sequence
  Synthetic Construct
tctccacagctcacgctggta

SEQ ID NO: 32769 - DNA, 21 bp, Artificial Sequence
  Synthetic Construct
ccagcacagcccatacagtag

SEQ ID NO: 32770 - DNA, 20 bp, Artificial Sequence
  Synthetic Construct
aggaaacaggtgcccctaca

SEQ ID NO: 32771 - DNA, 24 bp, Artificial Sequence
  Synthetic Construct
caaagtgaggcacgcatactcata

SEQ ID NO: 32772 - DNA, 19 bp, Artificial Sequence
  Synthetic Construct
ggggaggcagcatggaaaa

SEQ ID NO: 32773 - DNA, 18 bp, Artificial Sequence
  Synthetic Construct
agaggcgtccagcgtttc

SEQ ID NO: 32774 - DNA, 21 bp, Artificial Sequence
  Synthetic Construct
gcaccagcccttcctcacttt

SEQ ID NO: 32775 - DNA, 24 bp, Artificial Sequence
  Synthetic Construct
gcccgcttaatagctgaggtcaca

SEQ ID NO: 32776 - DNA, 26 bp, Artificial Sequence
  Synthetic Construct
cacagcttttacctcctaagaacttg

SEQ ID NO: 32777 - DNA, 25 bp, Artificial Sequence
  Synthetic Construct
ctctggacctcggtttctttgtttc

SEQ ID NO: 32778 - DNA, 21 bp, Artificial Sequence
  Synthetic Construct
gccacctgccatagccactta

SEQ ID NO: 32779 - DNA, 25 bp, Artificial Sequence
  Synthetic Construct
ccctaagaaccagcaccttctattg

SEQ ID NO: 32780 - DNA, 27 bp, Artificial Sequence
  Synthetic Construct
ctcaaaaccgaaatgtgaccctttttc

SEQ ID NO: 32781 - DNA, 19 bp, Artificial Sequence
  Synthetic Construct
cggtactcggccacaccaa

SEQ ID NO: 32782 - DNA, 27 bp, Artificial Sequence
  Synthetic Construct
ctcagtggcctgataattacattgagt

SEQ ID NO: 32783 - DNA, 26 bp, Artificial Sequence
  Synthetic Construct
cagccaccagctctgtatagtagtta

SEQ ID NO: 32784 - DNA, 20 bp, Artificial Sequence
  Synthetic Construct
ggccaggaagtccacaatca

SEQ ID NO: 32785 - DNA, 25 bp, Artificial Sequence
  Synthetic Construct
gcttcccatactggtcttgatggat

SEQ ID NO: 32786 - DNA, 19 bp, Artificial Sequence
  Synthetic Construct
acggagccggaatctctga

SEQ ID NO: 32787 - DNA, 24 bp, Artificial Sequence
  Synthetic Construct
cccctaaaaatgggtgcaggaatc

SEQ ID NO: 32788 - DNA, 26 bp, Artificial Sequence
  Synthetic Construct
gacccttcctaatcatggaagtcttt

SEQ ID NO: 32789 - DNA, 26 bp, Artificial Sequence
  Synthetic Construct
gtcttacaaagtcgttgatcccacaa

SEQ ID NO: 32790 - DNA, 22 bp, Artificial Sequence
  Synthetic Construct
tcgggccatgtcatctgaggat

SEQ ID NO: 32791 - DNA, 22 bp, Artificial Sequence
  Synthetic Construct
ggactggctgcctaaactgtca

SEQ ID NO: 32792 - DNA, 23 bp, Artificial Sequence
  Synthetic Construct
gcaaagtgaatctccacggaagt

SEQ ID NO: 32793 - DNA, 22 bp, Artificial Sequence
  Synthetic Construct
agagggttgcgtggatggttac

SEQ ID NO: 32794 - DNA, 23 bp, Artificial Sequence
  Synthetic Construct
gctcaccactgctcttgttcctt

SEQ ID NO: 32795 - DNA, 22 bp, Artificial Sequence
  Synthetic Construct
gccccaggaaatgtagccctat

SEQ ID NO: 32796 - DNA, 24 bp, Artificial Sequence
  Synthetic Construct
agatgctttgtcgcatgtagtttg

SEQ ID NO: 32797 - DNA, 23 bp, Artificial Sequence
  Synthetic Construct
tccattactggccttgacctttg

SEQ ID NO: 32798 - DNA, 20 bp, Artificial Sequence
  Synthetic Construct
agccaccacgttgctgtgat

SEQ ID NO: 32799 - DNA, 24 bp, Artificial Sequence
  Synthetic Construct
agtgacagctcaattctgatgcta

SEQ ID NO: 32800 - DNA, 22 bp, Artificial Sequence
  Synthetic Construct
ctgcaggtccatgtctctcttc

SEQ ID NO: 32801 - DNA, 22 bp, Artificial Sequence
  Synthetic Construct
gaacccaacagaacccaagact

SEQ ID NO: 32802 - DNA, 24 bp, Artificial Sequence
  Synthetic Construct
tgatgcttggatgaagtgatgctt

SEQ ID NO: 32803 - DNA, 20 bp, Artificial Sequence
  Synthetic Construct
acacagcagctccctcttgt

SEQ ID NO: 32804 - DNA, 23 bp, Artificial Sequence
  Synthetic Construct
gccaactaccagtcactgtatca

SEQ ID NO: 32805 - DNA, 25 bp, Artificial Sequence
  Synthetic Construct
aggagctaaacatacaatggtgaca

SEQ ID NO: 32806 - DNA, 24 bp, Artificial Sequence
  Synthetic Construct
gggtttgggctgttttcacgtcta

SEQ ID NO: 32807 - DNA, 24 bp, Artificial Sequence
  Synthetic Construct
gcagaagaagcatggggtttaagt

SEQ ID NO: 32808 - DNA, 25 bp, Artificial Sequence
  Synthetic Construct
ccccaagcctattgagacatctgta

SEQ ID NO: 32809 - DNA, 19 bp, Artificial Sequence
  Synthetic Construct
tctgcctgggctcccgaaa

SEQ ID NO: 32810 - DNA, 25 bp, Artificial Sequence
  Synthetic Construct
gaatgcatgtgggatccattactca

SEQ ID NO: 32811 - DNA, 22 bp, Artificial Sequence
  Synthetic Construct
tgaggagggaaggaaggaaact

SEQ ID NO: 32812 - DNA, 25 bp, Artificial Sequence
  Synthetic Construct
tgatggaagatgaacactccacttg

SEQ ID NO: 32813 - DNA, 24 bp, Artificial Sequence
  Synthetic Construct
gtttcatgtgggtttttggcagtt

SEQ ID NO: 32814 - DNA, 25 bp, Artificial Sequence
  Synthetic Construct
agagctgcctaaagctatcctctta

SEQ ID NO: 32815 - DNA, 20 bp, Artificial Sequence
  Synthetic Construct
acttggctagggccttcaga

SEQ ID NO: 32816 - DNA, 26 bp, Artificial Sequence
  Synthetic Construct
gtgttcccatcacatttttcggtatg

SEQ ID NO: 32817 - DNA, 25 bp, Artificial Sequence
  Synthetic Construct
ggtgcaaaatctcattctccttgaa

SEQ ID NO: 32818 - DNA, 21 bp, Artificial Sequence
  Synthetic Construct
tgaaggtggggagggtaaagt

SEQ ID NO: 32819 - DNA, 23 bp, Artificial Sequence
  Synthetic Construct
ggtgagttcctcgaatggtgcat

SEQ ID NO: 32820 - DNA, 20 bp, Artificial Sequence
  Synthetic Construct
agcaggccctgagttcttgt

SEQ ID NO: 32821 - DNA, 20 bp, Artificial Sequence
  Synthetic Construct
caggctcatgggcagaaagt

SEQ ID NO: 32822 - DNA, 18 bp, Artificial Sequence
  Synthetic Construct
tgcccggcctgtgaacat

SEQ ID NO: 32823 - DNA, 23 bp, Artificial Sequence
  Synthetic Construct
atgcacggaatacctctggaaat

SEQ ID NO: 32824 - DNA, 20 bp, Artificial Sequence
  Synthetic Construct
cgtggcccatgaagggtgaa

SEQ ID NO: 32825 - DNA, 20 bp, Artificial Sequence
  Synthetic Construct
tcctgccaccccttctccat

SEQ ID NO: 32826 - DNA, 23 bp, Artificial Sequence
  Synthetic Construct
agactccaccttgcttctgatct

SEQ ID NO: 32827 - DNA, 24 bp, Artificial Sequence
  Synthetic Construct
agaacagcctgattgcaaagatga

SEQ ID NO: 32828 - DNA, 24 bp, Artificial Sequence
  Synthetic Construct
aaattggtgggataccatgtccaa

SEQ ID NO: 32829 - DNA, 22 bp, Artificial Sequence
  Synthetic Construct
tccatgcccacctaacatctca

SEQ ID NO: 32830 - DNA, 22 bp, Artificial Sequence
  Synthetic Construct
ggatgggcaagtggttgtatct

SEQ ID NO: 32831 - DNA, 21 bp, Artificial Sequence
  Synthetic Construct
tgagtgtccctgacctcaagt

SEQ ID NO: 32832 - DNA, 20 bp, Artificial Sequence
  Synthetic Construct
aggccaagtccacacgatct

SEQ ID NO: 32833 - DNA, 22 bp, Artificial Sequence
  Synthetic Construct
ggtggggagcactgttctcaag

SEQ ID NO: 32834 - DNA, 20 bp, Artificial Sequence
  Synthetic Construct
tgcagagcaggacagggatt

SEQ ID NO: 32835 - DNA, 18 bp, Artificial Sequence
  Synthetic Construct
cggctcttcgtggcttca

SEQ ID NO: 32836 - DNA, 25 bp, Artificial Sequence
  Synthetic Construct
gcactcctgaaaagtggacccaaat

SEQ ID NO: 32837 - DNA, 25 bp, Artificial Sequence
  Synthetic Construct
gacccacaaagctgaagatgtttac

SEQ ID NO: 32838 - DNA, 23 bp, Artificial Sequence
  Synthetic Construct
agggattcaggctgtttccattc

SEQ ID NO: 32839 - DNA, 26 bp, Artificial Sequence
  Synthetic Construct
cagtctttacttagtgggcccaaatc

SEQ ID NO: 32840 - DNA, 24 bp, Artificial Sequence
  Synthetic Construct
ggaaatcaggaaggtgatgtgtca

SEQ ID NO: 32841 - DNA, 22 bp, Artificial Sequence
  Synthetic Construct
acagcagggacaaaaaggatca

SEQ ID NO: 32842 - DNA, 20 bp, Artificial Sequence
  Synthetic Construct
tttcccaacggcctctcaca

SEQ ID NO: 32843 - DNA, 22 bp, Artificial Sequence
  Synthetic Construct
tggtcctctggctagaaacagt

SEQ ID NO: 32844 - DNA, 23 bp, Artificial Sequence
  Synthetic Construct
gctgtgcagtgagatacaggtaa

SEQ ID NO: 32845 - DNA, 23 bp, Artificial Sequence
  Synthetic Construct
cacagtcccaggctgacttcatt

SEQ ID NO: 32846 - DNA, 18 bp, Artificial Sequence
  Synthetic Construct
ccaagccctgctggttca

SEQ ID NO: 32847 - DNA, 24 bp, Artificial Sequence
  Synthetic Construct
ggaggagaagactcatccagtcaa

SEQ ID NO: 32848 - DNA, 28 bp, Artificial Sequence
  Synthetic Construct
ccattaagtccaagatagaggagccatt

SEQ ID NO: 32849 - DNA, 20 bp, Artificial Sequence
  Synthetic Construct
acaactcagcggctcgtaag

SEQ ID NO: 32850 - DNA, 22 bp, Artificial Sequence
  Synthetic Construct
ctcacgcttgtgaaaccaacat

SEQ ID NO: 32851 - DNA, 22 bp, Artificial Sequence
  Synthetic Construct
acagctccaggggcactaaact

SEQ ID NO: 32852 - DNA, 22 bp, Artificial Sequence
  Synthetic Construct
ggcccacctcctcaggattaga

SEQ ID NO: 32853 - DNA, 23 bp, Artificial Sequence
  Synthetic Construct
ctggagctagaggaaagggtgaa

SEQ ID NO: 32854 - DNA, 22 bp, Artificial Sequence
  Synthetic Construct
gcaggcaccacaagctttcttc

SEQ ID NO: 32855 - DNA, 21 bp, Artificial Sequence
  Synthetic Construct
gcaaccttggtgagtgagtct

SEQ ID NO: 32856 - DNA, 20 bp, Artificial Sequence
  Synthetic Construct
accatgtggggctcagaatg

SEQ ID NO: 32857 - DNA, 25 bp, Artificial Sequence
  Synthetic Construct
ccgctagaaaatttcgcaggattag

SEQ ID NO: 32858 - DNA, 27 bp, Artificial Sequence
  Synthetic Construct
ccctttcccaaaactaaaccacctttg

SEQ ID NO: 32859 - DNA, 20 bp, Artificial Sequence
  Synthetic Construct
tcaagagggcagtccaggaa

SEQ ID NO: 32860 - DNA, 20 bp, Artificial Sequence
  Synthetic Construct
acggacccatgtgactgtct

SEQ ID NO: 32861 - DNA, 26 bp, Artificial Sequence
  Synthetic Construct
gctcccttcagaagcatgtacactaa

SEQ ID NO: 32862 - DNA, 23 bp, Artificial Sequence
  Synthetic Construct
attaggcccaagctggccagaag

SEQ ID NO: 32863 - DNA, 23 bp, Artificial Sequence
  Synthetic Construct
gtcaatgcctgcaacaatgacaa

SEQ ID NO: 32864 - DNA, 23 bp, Artificial Sequence
  Synthetic Construct
tgggtctcaaagtggttggattc

SEQ ID NO: 32865 - DNA, 27 bp, Artificial Sequence
  Synthetic Construct
gagaacttctagagaaacagggtagtt

SEQ ID NO: 32866 - DNA, 28 bp, Artificial Sequence
  Synthetic Construct
gagtcccaggactacagatctagtgaaa

SEQ ID NO: 32867 - DNA, 23 bp, Artificial Sequence
  Synthetic Construct
ccagcttaactcccagctgtcaa

SEQ ID NO: 32868 - DNA, 22 bp, Artificial Sequence
  Synthetic Construct
agctcccctctgggtgagtatt

SEQ ID NO: 32869 - DNA, 24 bp, Artificial Sequence
  Synthetic Construct
ccccacaatggcaggatctacaac

SEQ ID NO: 32870 - DNA, 24 bp, Artificial Sequence
  Synthetic Construct
tggtaccacaaagtcagaaacgta

SEQ ID NO: 32871 - DNA, 22 bp, Artificial Sequence
  Synthetic Construct
ggtccctcagtgttgcagctat

SEQ ID NO: 32872 - DNA, 24 bp, Artificial Sequence
  Synthetic Construct
gctctgtacccacactaaggaaag

SEQ ID NO: 32873 - DNA, 21 bp, Artificial Sequence
  Synthetic Construct
gccagacaagtagcccacaga

SEQ ID NO: 32874 - DNA, 25 bp, Artificial Sequence
  Synthetic Construct
gccttcaagagactcatctaacaca

SEQ ID NO: 32875 - DNA, 23 bp, Artificial Sequence
  Synthetic Construct
gctgccaaagtgagcacaattca

SEQ ID NO: 32876 - DNA, 20 bp, Artificial Sequence
  Synthetic Construct
ttgccagtgcttccaactca

SEQ ID NO: 32877 - DNA, 21 bp, Artificial Sequence
  Synthetic Construct
cccatcactccgcaagagaca

SEQ ID NO: 32878 - DNA, 22 bp, Artificial Sequence
  Synthetic Construct
tgtctgccggagggcttatagt

SEQ ID NO: 32879 - DNA, 22 bp, Artificial Sequence
  Synthetic Construct
ggacagggcactatgtggaaag

SEQ ID NO: 32880 - DNA, 29 bp, Artificial Sequence
  Synthetic Construct
cagatggaatctgtcttagatgtggatgt

SEQ ID NO: 32881 - DNA, 26 bp, Artificial Sequence
  Synthetic Construct
gagagatgccaagagtccatacattg

SEQ ID NO: 32882 - DNA, 20 bp, Artificial Sequence
  Synthetic Construct
ctcacggggctcctttttga

SEQ ID NO: 32883 - DNA, 22 bp, Artificial Sequence
  Synthetic Construct
gtgggatggaaggtccagaaac

SEQ ID NO: 32884 - DNA, 19 bp, Artificial Sequence
  Synthetic Construct
tgcacctaggcggctgtga

SEQ ID NO: 32885 - DNA, 25 bp, Artificial Sequence
  Synthetic Construct
gggacacaataccatgcctttgtta

SEQ ID NO: 32886 - DNA, 20 bp, Artificial Sequence
  Synthetic Construct
cgtgcaggacttgtcgttct

SEQ ID NO: 32887 - DNA, 23 bp, Artificial Sequence
  Synthetic Construct
gcctcttctgtattgctcgtttg

SEQ ID NO: 32888 - DNA, 27 bp, Artificial Sequence
  Synthetic Construct
gactagaagaccactttttcccaaatg

SEQ ID NO: 32889 - DNA, 25 bp, Artificial Sequence
  Synthetic Construct
ctgaggttcacactgaaaggaacaa

SEQ ID NO: 32890 - DNA, 30 bp, Artificial Sequence
  Synthetic Construct
gacaagttacgaagtcactgaatcctcttt

SEQ ID NO: 32891 - DNA, 21 bp, Artificial Sequence
  Synthetic Construct
gtgccatgtttcctgccactt

SEQ ID NO: 32892 - DNA, 24 bp, Artificial Sequence
  Synthetic Construct
aaagtcctcagagaccaagagttg

SEQ ID NO: 32893 - DNA, 26 bp, Artificial Sequence
  Synthetic Construct
cctctcccttttcctcttgtctttta

SEQ ID NO: 32894 - DNA, 29 bp, Artificial Sequence
  Synthetic Construct
ggctatgtatgcccttgtgtgtcatattc

SEQ ID NO: 32895 - DNA, 25 bp, Artificial Sequence
  Synthetic Construct
caggggcctgatagtgaactaaatc

SEQ ID NO: 32896 - DNA, 25 bp, Artificial Sequence
  Synthetic Construct
tgtaagcctagttccttcctcattc

SEQ ID NO: 32897 - DNA, 26 bp, Artificial Sequence
  Synthetic Construct
ctccttctttctccaggaaccattag

SEQ ID NO: 32898 - DNA, 21 bp, Artificial Sequence
  Synthetic Construct
gggtcctacagggcacagact

SEQ ID NO: 32899 - DNA, 23 bp, Artificial Sequence
  Synthetic Construct
tgggtttctgttgcagtttgact

SEQ ID NO: 32900 - DNA, 22 bp, Artificial Sequence
  Synthetic Construct
ctcccagcttcatgggagtttc

SEQ ID NO: 32901 - DNA, 25 bp, Artificial Sequence
  Synthetic Construct
agcagactcttaaaatccgatctgt

SEQ ID NO: 32902 - DNA, 23 bp, Artificial Sequence
  Synthetic Construct
tgcagccataggtaaatggcttt

SEQ ID NO: 32903 - DNA, 23 bp, Artificial Sequence
  Synthetic Construct
gacagcctttccagtgctattca

SEQ ID NO: 32904 - DNA, 20 bp, Artificial Sequence
  Synthetic Construct
tctttcccgcctgagtgtca

SEQ ID NO: 32905 - DNA, 20 bp, Artificial Sequence
  Synthetic Construct
tgctgccaggtaagatgcaa

SEQ ID NO: 32906 - DNA, 23 bp, Artificial Sequence
  Synthetic Construct
ggtgactcaggaacaggagaact

SEQ ID NO: 32907 - DNA, 20 bp, Artificial Sequence
  Synthetic Construct
gctccaccaccatcaacact

SEQ ID NO: 32908 - DNA, 21 bp, Artificial Sequence
  Synthetic Construct
ctgcagttgcttctcctcaca

SEQ ID NO: 32909 - DNA, 24 bp, Artificial Sequence
  Synthetic Construct
gttcccagtgtacttggatcacat

SEQ ID NO: 32910 - DNA, 27 bp, Artificial Sequence
  Synthetic Construct
cttgagtgtgactgaggtaaatgaaag

SEQ ID NO: 32911 - DNA, 22 bp, Artificial Sequence
  Synthetic Construct
cccctgtggacactcgactaca

SEQ ID NO: 32912 - DNA, 24 bp, Artificial Sequence
  Synthetic Construct
cctcatttccaccatcctgtcctt

SEQ ID NO: 32913 - DNA, 24 bp, Artificial Sequence
  Synthetic Construct
agagtctggccaaattccagtaaa

SEQ ID NO: 32914 - DNA, 20 bp, Artificial Sequence
  Synthetic Construct
ggcagcaatgcctgctacat

SEQ ID NO: 32915 - DNA, 20 bp, Artificial Sequence
  Synthetic Construct
tgccagggtcaatggaggaa

SEQ ID NO: 32916 - DNA, 24 bp, Artificial Sequence
  Synthetic Construct
cagccaaacagaatactccagctt

SEQ ID NO: 32917 - DNA, 22 bp, Artificial Sequence
  Synthetic Construct
tcaacctcccctgccatggtta

SEQ ID NO: 32918 - DNA, 21 bp, Artificial Sequence
  Synthetic Construct
agccggatggtccagagatga

SEQ ID NO: 32919 - DNA, 22 bp, Artificial Sequence
  Synthetic Construct
tttgccagaagttcagcagtct

SEQ ID NO: 32920 - DNA, 23 bp, Artificial Sequence
  Synthetic Construct
ggggacaagcaaggcattagtgt

SEQ ID NO: 32921 - DNA, 24 bp, Artificial Sequence
  Synthetic Construct
tcccaaatgagaccagagttgaag

SEQ ID NO: 32922 - DNA, 22 bp, Artificial Sequence
  Synthetic Construct
gacgaatgtcctcagcactaca

SEQ ID NO: 32923 - DNA, 25 bp, Artificial Sequence
  Synthetic Construct
tgtttaacacgagacagaacccaaa

SEQ ID NO: 32924 - DNA, 21 bp, Artificial Sequence
  Synthetic Construct
ccagctcacgtgtgtggctta

SEQ ID NO: 32925 - DNA, 24 bp, Artificial Sequence
  Synthetic Construct
cctcaacagccctgagtctgtttc

SEQ ID NO: 32926 - DNA, 23 bp, Artificial Sequence
  Synthetic Construct
cgaagaggggatccagctctaat

SEQ ID NO: 32927 - DNA, 22 bp, Artificial Sequence
  Synthetic Construct
ccatgccagcagaactttcact

SEQ ID NO: 32928 - DNA, 27 bp, Artificial Sequence
  Synthetic Construct
gtaggataaattaaggcaagcgtcttc

SEQ ID NO: 32929 - DNA, 26 bp, Artificial Sequence
  Synthetic Construct
catttcccatcatcctggttcttttc

SEQ ID NO: 32930 - DNA, 23 bp, Artificial Sequence
  Synthetic Construct
ggcttcaggcaccagaatacaca

SEQ ID NO: 32931 - DNA, 22 bp, Artificial Sequence
  Synthetic Construct
ggctgagggccttcaatcaaca

SEQ ID NO: 32932 - DNA, 19 bp, Artificial Sequence
  Synthetic Construct
gtgcagtggcgatggtagt

SEQ ID NO: 32933 - DNA, 21 bp, Artificial Sequence
  Synthetic Construct
gttcacaccaggcagtgatct

SEQ ID NO: 32934 - DNA, 23 bp, Artificial Sequence
  Synthetic Construct
gctcttggacagcacaggtctat

SEQ ID NO: 32935 - DNA, 23 bp, Artificial Sequence
  Synthetic Construct
gcctaggcagcatagtgagattc

SEQ ID NO: 32936 - DNA, 25 bp, Artificial Sequence
  Synthetic Construct
cacagaaaactaagtcgcccagagt

SEQ ID NO: 32937 - DNA, 20 bp, Artificial Sequence
  Synthetic Construct
acctggactcctgcttgctt

SEQ ID NO: 32938 - DNA, 23 bp, Artificial Sequence
  Synthetic Construct
ggaggttattggcttctgcttct

SEQ ID NO: 32939 - DNA, 23 bp, Artificial Sequence
  Synthetic Construct
agcaaggttcagtctggaaatga

SEQ ID NO: 32940 - DNA, 26 bp, Artificial Sequence
  Synthetic Construct
gttcagacccacgaaaagtacttgaa

SEQ ID NO: 32941 - DNA, 22 bp, Artificial Sequence
  Synthetic Construct
cagcaactaaggctttgccatt

SEQ ID NO: 32942 - DNA, 24 bp, Artificial Sequence
  Synthetic Construct
ccctctgggtcatcccttcatttc

SEQ ID NO: 32943 - DNA, 22 bp, Artificial Sequence
  Synthetic Construct
cctcccctcctcagcatcattg

SEQ ID NO: 32944 - DNA, 22 bp, Artificial Sequence
  Synthetic Construct
ctgggagcagaacccagcattt

SEQ ID NO: 32945 - DNA, 25 bp, Artificial Sequence
  Synthetic Construct
gaggagtcaggtcaggagtagaaac

SEQ ID NO: 32946 - DNA, 22 bp, Artificial Sequence
  Synthetic Construct
gctcgagagttggttgcagttg

SEQ ID NO: 32947 - DNA, 21 bp, Artificial Sequence
  Synthetic Construct
tcagacaggccatgggatcta

SEQ ID NO: 32948 - DNA, 23 bp, Artificial Sequence
  Synthetic Construct
gcaatggaagggtagtgggtact

SEQ ID NO: 32949 - DNA, 20 bp, Artificial Sequence
  Synthetic Construct
ctgacgctggatggccaaat

SEQ ID NO: 32950 - DNA, 23 bp, Artificial Sequence
  Synthetic Construct
gccactggacttacttcgcaaat

SEQ ID NO: 32951 - DNA, 24 bp, Artificial Sequence
  Synthetic Construct
ctgaactggcttcacaaaaacaca

SEQ ID NO: 32952 - DNA, 20 bp, Artificial Sequence
  Synthetic Construct
gccgcagcagcttctcattc

SEQ ID NO: 32953 - DNA, 27 bp, Artificial Sequence
  Synthetic Construct
gttctagcattggaggaaatccaaagt

SEQ ID NO: 32954 - DNA, 24 bp, Artificial Sequence
  Synthetic Construct
acttgagtgtttgggtcaacaaga

SEQ ID NO: 32955 - DNA, 21 bp, Artificial Sequence
  Synthetic Construct
agagccctgctcctagtctct

SEQ ID NO: 32956 - DNA, 22 bp, Artificial Sequence
  Synthetic Construct
gccatctggaggcagctgaaat

SEQ ID NO: 32957 - DNA, 26 bp, Artificial Sequence
  Synthetic Construct
ccccaatacctttaaagctggagcaa

SEQ ID NO: 32958 - DNA, 23 bp, Artificial Sequence
  Synthetic Construct
agactagctgagggaaagtgtga

SEQ ID NO: 32959 - DNA, 22 bp, Artificial Sequence
  Synthetic Construct
cctggattgccccacattccat

SEQ ID NO: 32960 - DNA, 20 bp, Artificial Sequence
  Synthetic Construct
ggcctcgtaaaaggcaggat

SEQ ID NO: 32961 - DNA, 23 bp, Artificial Sequence
  Synthetic Construct
tgacgactggattgtccaacaaa

SEQ ID NO: 32962 - DNA, 22 bp, Artificial Sequence
  Synthetic Construct
tgagtccaggtgactgtaggaa

SEQ ID NO: 32963 - DNA, 20 bp, Artificial Sequence
  Synthetic Construct
agacccagggcacttctgat

SEQ ID NO: 32964 - DNA, 27 bp, Artificial Sequence
  Synthetic Construct
ctcatctctgggtctctcctttagatg

SEQ ID NO: 32965 - DNA, 23 bp, Artificial Sequence
  Synthetic Construct
aggtgtcctcctcccattcttag

SEQ ID NO: 32966 - DNA, 22 bp, Artificial Sequence
  Synthetic Construct
tgaggttgcaattcacccagaa

SEQ ID NO: 32967 - DNA, 22 bp, Artificial Sequence
  Synthetic Construct
ggtgtgcatctgtgggcatatc

SEQ ID NO: 32968 - DNA, 24 bp, Artificial Sequence
  Synthetic Construct
gtgccctaatgatcagtcttcagt

SEQ ID NO: 32969 - DNA, 20 bp, Artificial Sequence
  Synthetic Construct
agccacaggcgagcacatag

SEQ ID NO: 32970 - DNA, 21 bp, Artificial Sequence
  Synthetic Construct
ccccaaacccttcggttttca

SEQ ID NO: 32971 - DNA, 23 bp, Artificial Sequence
  Synthetic Construct
aggataatgctggcaaagacaca

SEQ ID NO: 32972 - DNA, 27 bp, Artificial Sequence
  Synthetic Construct
ctctgtaactttctggcattggagtct

SEQ ID NO: 32973 - DNA, 20 bp, Artificial Sequence
  Synthetic Construct
tgcagctgggcttagcaact

SEQ ID NO: 32974 - DNA, 21 bp, Artificial Sequence
  Synthetic Construct
acccctaccccaggagttttg

SEQ ID NO: 32975 - DNA, 19 bp, Artificial Sequence
  Synthetic Construct
cggtgcccaagggcatgat

SEQ ID NO: 32976 - DNA, 27 bp, Artificial Sequence
  Synthetic Construct
gttctgtgttagaagccctattcattc

SEQ ID NO: 32977 - DNA, 26 bp, Artificial Sequence
  Synthetic Construct
gtggctttttggtaattgtgctgaac

SEQ ID NO: 32978 - DNA, 22 bp, Artificial Sequence
  Synthetic Construct
gctctgccgaggctggtaaaaa

SEQ ID NO: 32979 - DNA, 22 bp, Artificial Sequence
  Synthetic Construct
cccaaaatgcccgtctgtgaag

SEQ ID NO: 32980 - DNA, 21 bp, Artificial Sequence
  Synthetic Construct
tgacgaaaggccgtgtagtag

SEQ ID NO: 32981 - DNA, 23 bp, Artificial Sequence
  Synthetic Construct
acctgaaagagggaagtccaaag

SEQ ID NO: 32982 - DNA, 28 bp, Artificial Sequence
  Synthetic Construct
ggaaactaactctgggatcagacaaact

SEQ ID NO: 32983 - DNA, 25 bp, Artificial Sequence
  Synthetic Construct
acttagttcaggggctacacaaaaa

SEQ ID NO: 32984 - DNA, 24 bp, Artificial Sequence
  Synthetic Construct
gtggagaacagaaccaggtcaaac

SEQ ID NO: 32985 - DNA, 25 bp, Artificial Sequence
  Synthetic Construct
ctctgaggttctaggctatgacaga

SEQ ID NO: 32986 - DNA, 24 bp, Artificial Sequence
  Synthetic Construct
caaatgttatcccctctgcaccta

SEQ ID NO: 32987 - DNA, 27 bp, Artificial Sequence
  Synthetic Construct
gatggaaaagagggaattgcaagtaga

SEQ ID NO: 32988 - DNA, 25 bp, Artificial Sequence
  Synthetic Construct
ctggaacccagacaaatgaccttgt

SEQ ID NO: 32989 - DNA, 21 bp, Artificial Sequence
  Synthetic Construct
gcaaggaggtgggatgagaca

SEQ ID NO: 32990 - DNA, 25 bp, Artificial Sequence
  Synthetic Construct
ggagatctttaggatgagcagcaat

SEQ ID NO: 32991 - DNA, 22 bp, Artificial Sequence
  Synthetic Construct
cacattctggaactgcccttct

SEQ ID NO: 32992 - DNA, 24 bp, Artificial Sequence
  Synthetic Construct
gcagaagagagctgaggttagatg

SEQ ID NO: 32993 - DNA, 24 bp, Artificial Sequence
  Synthetic Construct
tctaatggacagcattgggtcaaa

SEQ ID NO: 32994 - DNA, 23 bp, Artificial Sequence
  Synthetic Construct
ggatggagggagccatttttagt

SEQ ID NO: 32995 - DNA, 23 bp, Artificial Sequence
  Synthetic Construct
gctagttgaggaagcccaagtat

SEQ ID NO: 32996 - DNA, 22 bp, Artificial Sequence
  Synthetic Construct
ccagtccctcgtttcctcacaa

SEQ ID NO: 32997 - DNA, 22 bp, Artificial Sequence
  Synthetic Construct
ggcagccttccatgtcacttac

SEQ ID NO: 32998 - DNA, 22 bp, Artificial Sequence
  Synthetic Construct
aaggtagcacgattcacagcat

SEQ ID NO: 32999 - DNA, 22 bp, Artificial Sequence
  Synthetic Construct
ggaattgcacggcagcctttac

SEQ ID NO: 33000 - DNA, 24 bp, Artificial Sequence
  Synthetic Construct
cccacatgagctggcttcattttc

SEQ ID NO: 33001 - DNA, 19 bp, Artificial Sequence
  Synthetic Construct
gccttgctggagtgcaaac

SEQ ID NO: 33002 - DNA, 21 bp, Artificial Sequence
  Synthetic Construct
gctgatcatgtcaccgctttg

SEQ ID NO: 33003 - DNA, 24 bp, Artificial Sequence
  Synthetic Construct
gttgacaatcctctctccacttct

SEQ ID NO: 33004 - DNA, 23 bp, Artificial Sequence
  Synthetic Construct
cccagatgcctgtggagtcacta

SEQ ID NO: 33005 - DNA, 24 bp, Artificial Sequence
  Synthetic Construct
agagaaagtggccctgaagataag

SEQ ID NO: 33006 - DNA, 27 bp, Artificial Sequence
  Synthetic Construct
ggagaagactactcgtaccgtgacaat

SEQ ID NO: 33007 - DNA, 20 bp, Artificial Sequence
  Synthetic Construct
cgccaggcttgcagttgtat

SEQ ID NO: 33008 - DNA, 21 bp, Artificial Sequence
  Synthetic Construct
gatcatgctcccaaccgtagt

SEQ ID NO: 33009 - DNA, 25 bp, Artificial Sequence
  Synthetic Construct
cgtgttggatcctttgagaaaaact

SEQ ID NO: 33010 - DNA, 23 bp, Artificial Sequence
  Synthetic Construct
gggagctgatgggctctctttag

SEQ ID NO: 33011 - DNA, 24 bp, Artificial Sequence
  Synthetic Construct
tggtctgttagcacacccaattat

SEQ ID NO: 33012 - DNA, 27 bp, Artificial Sequence
  Synthetic Construct
gaacacatcttaggagggaatatgtct

SEQ ID NO: 33013 - DNA, 22 bp, Artificial Sequence
  Synthetic Construct
gcagtgcagggttcttacattc

SEQ ID NO: 33014 - DNA, 22 bp, Artificial Sequence
  Synthetic Construct
cgcttaccctggcatcttctct

SEQ ID NO: 33015 - DNA, 23 bp, Artificial Sequence
  Synthetic Construct
ctgtaaaaggcctgctttgttga

SEQ ID NO: 33016 - DNA, 23 bp, Artificial Sequence
  Synthetic Construct
ttgacatattcagccctcagcat

SEQ ID NO: 33017 - DNA, 22 bp, Artificial Sequence
  Synthetic Construct
acggtgcccttgggttactaga

SEQ ID NO: 33018 - DNA, 24 bp, Artificial Sequence
  Synthetic Construct
gggctacaaactaaggccaaaaac

SEQ ID NO: 33019 - DNA, 21 bp, Artificial Sequence
  Synthetic Construct
gcctctgctgctcgcatgtat

SEQ ID NO: 33020 - DNA, 25 bp, Artificial Sequence
  Synthetic Construct
actattcagacatcacctcctccat

SEQ ID NO: 33021 - DNA, 21 bp, Artificial Sequence
  Synthetic Construct
accctctggggttctggctat

SEQ ID NO: 33022 - DNA, 25 bp, Artificial Sequence
  Synthetic Construct
cacagtaaacaacccagcacatatt

SEQ ID NO: 33023 - DNA, 25 bp, Artificial Sequence
  Synthetic Construct
ttgcaagaacacccataacctctta

SEQ ID NO: 33024 - DNA, 27 bp, Artificial Sequence
  Synthetic Construct
gagctaacaatgcaaggtaaagcgaat

SEQ ID NO: 33025 - DNA, 29 bp, Artificial Sequence
  Synthetic Construct
gctgtttatcagtgaaatcccagtcactt

SEQ ID NO: 33026 - DNA, 22 bp, Artificial Sequence
  Synthetic Construct
ggacagacacggggtcaaattc

SEQ ID NO: 33027 - DNA, 23 bp, Artificial Sequence
  Synthetic Construct
ggagtgacgctccttcctaccta

SEQ ID NO: 33028 - DNA, 26 bp, Artificial Sequence
  Synthetic Construct
ggtaggaatgtttcccaagctattca

SEQ ID NO: 33029 - DNA, 26 bp, Artificial Sequence
  Synthetic Construct
ggatacacattctctcctatctgcat

SEQ ID NO: 33030 - DNA, 21 bp, Artificial Sequence
  Synthetic Construct
ccctcagacctcagctggttt

SEQ ID NO: 33031 - DNA, 22 bp, Artificial Sequence
  Synthetic Construct
ctggtcccggctactgacattt

SEQ ID NO: 33032 - DNA, 26 bp, Artificial Sequence
  Synthetic Construct
tgttagcctgtaacttgtccttcttg

SEQ ID NO: 33033 - DNA, 21 bp, Artificial Sequence
  Synthetic Construct
gccggctgggtttgaccaata

SEQ ID NO: 33034 - DNA, 21 bp, Artificial Sequence
  Synthetic Construct
gcacagccccttcacttctct

SEQ ID NO: 33035 - DNA, 20 bp, Artificial Sequence
  Synthetic Construct
gcaggcaagcatgcaccttt

SEQ ID NO: 33036 - DNA, 21 bp, Artificial Sequence
  Synthetic Construct
ggcctccgctgtgattcactt

SEQ ID NO: 33037 - DNA, 27 bp, Artificial Sequence
  Synthetic Construct
gcattaagagtcatacagcagagtcat

SEQ ID NO: 33038 - DNA, 20 bp, Artificial Sequence
  Synthetic Construct
atgcgccaggagggttcttg

SEQ ID NO: 33039 - DNA, 23 bp, Artificial Sequence
  Synthetic Construct
gtctagcactggtagcactggat

SEQ ID NO: 33040 - DNA, 27 bp, Artificial Sequence
  Synthetic Construct
ctctagacacacaactgtctctttttc

SEQ ID NO: 33041 - DNA, 24 bp, Artificial Sequence
  Synthetic Construct
gacatttgacagtggtttgtgtga

SEQ ID NO: 33042 - DNA, 30 bp, Artificial Sequence
  Synthetic Construct
gccctttgtcttcttgctaacttcaatatg

SEQ ID NO: 33043 - DNA, 24 bp, Artificial Sequence
  Synthetic Construct
aagctggacccactaatttgaagt

SEQ ID NO: 33044 - DNA, 23 bp, Artificial Sequence
  Synthetic Construct
gagcctcagcatcaaaccatcat

SEQ ID NO: 33045 - DNA, 25 bp, Artificial Sequence
  Synthetic Construct
gagagcttactcctcaagtgtcttt

SEQ ID NO: 33046 - DNA, 20 bp, Artificial Sequence
  Synthetic Construct
tgccttggcaagctcaagtt

SEQ ID NO: 33047 - DNA, 23 bp, Artificial Sequence
  Synthetic Construct
gcaattcctgacctgcatctttc

SEQ ID NO: 33048 - DNA, 23 bp, Artificial Sequence
  Synthetic Construct
ccttacgcagttgctggtgaaag

SEQ ID NO: 33049 - DNA, 20 bp, Artificial Sequence
  Synthetic Construct
agctgcttggtcacccaaag

SEQ ID NO: 33050 - DNA, 24 bp, Artificial Sequence
  Synthetic Construct
ttcttccctcctagagatggtcaa

SEQ ID NO: 33051 - DNA, 19 bp, Artificial Sequence
  Synthetic Construct
aggccaatgccgtcttgaa

SEQ ID NO: 33052 - DNA, 22 bp, Artificial Sequence
  Synthetic Construct
cagagccttggcatagtccttt

SEQ ID NO: 33053 - DNA, 21 bp, Artificial Sequence
  Synthetic Construct
agggccgtagaggcagaacat

SEQ ID NO: 33054 - DNA, 25 bp, Artificial Sequence
  Synthetic Construct
gaaggaaatccagtctgatggaaga

SEQ ID NO: 33055 - DNA, 23 bp, Artificial Sequence
  Synthetic Construct
ccagtggcatggagtcaggatag

SEQ ID NO: 33056 - DNA, 24 bp, Artificial Sequence
  Synthetic Construct
gacctcacacaggtaaccctttca

SEQ ID NO: 33057 - DNA, 20 bp, Artificial Sequence
  Synthetic Construct
cggctgctggacaatccttt

SEQ ID NO: 33058 - DNA, 21 bp, Artificial Sequence
  Synthetic Construct
acgcataataccggcctttgt

SEQ ID NO: 33059 - DNA, 27 bp, Artificial Sequence
  Synthetic Construct
gaaacagctctcagaatctaaggtttc

SEQ ID NO: 33060 - DNA, 24 bp, Artificial Sequence
  Synthetic Construct
tcaagcaggtaccaaatcctttct

SEQ ID NO: 33061 - DNA, 26 bp, Artificial Sequence
  Synthetic Construct
ccccagaggaggattgggagaataag

SEQ ID NO: 33062 - DNA, 20 bp, Artificial Sequence
  Synthetic Construct
agcatcgaccctgctttgaa

SEQ ID NO: 33063 - DNA, 22 bp, Artificial Sequence
  Synthetic Construct
tctccaactgtcccctttggaa

SEQ ID NO: 33064 - DNA, 25 bp, Artificial Sequence
  Synthetic Construct
ccaacttggcctctaatgaaatgtt

SEQ ID NO: 33065 - DNA, 26 bp, Artificial Sequence
  Synthetic Construct
ggagtaaaggtatcaaccacccttga

SEQ ID NO: 33066 - DNA, 25 bp, Artificial Sequence
  Synthetic Construct
acagccctatcatagcctttacttc

SEQ ID NO: 33067 - DNA, 24 bp, Artificial Sequence
  Synthetic Construct
cactcccatgcccaccattttatg

SEQ ID NO: 33068 - DNA, 24 bp, Artificial Sequence
  Synthetic Construct
caatgctgtctttcccaactcttt

SEQ ID NO: 33069 - DNA, 24 bp, Artificial Sequence
  Synthetic Construct
agcctagttaggacacttgacact

SEQ ID NO: 33070 - DNA, 23 bp, Artificial Sequence
  Synthetic Construct
tcctgtgaagccaatgaacacaa

SEQ ID NO: 33071 - DNA, 20 bp, Artificial Sequence
  Synthetic Construct
ggatgcgagtggctcattca

SEQ ID NO: 33072 - DNA, 22 bp, Artificial Sequence
  Synthetic Construct
tgcaacaatttgcaagccaaga

SEQ ID NO: 33073 - DNA, 23 bp, Artificial Sequence
  Synthetic Construct
ggtctgacttggcaggaaataca

SEQ ID NO: 33074 - DNA, 24 bp, Artificial Sequence
  Synthetic Construct
ccactcctcagaaccagtgatgat

SEQ ID NO: 33075 - DNA, 23 bp, Artificial Sequence
  Synthetic Construct
agccaccctagtcctctccttct

SEQ ID NO: 33076 - DNA, 21 bp, Artificial Sequence
  Synthetic Construct
tgatgtggaggaggcaacaga

SEQ ID NO: 33077 - DNA, 24 bp, Artificial Sequence
  Synthetic Construct
ctgaagaatggggcaataggaagt

SEQ ID NO: 33078 - DNA, 25 bp, Artificial Sequence
  Synthetic Construct
gcagttctgaagagaggctttgaac

SEQ ID NO: 33079 - DNA, 25 bp, Artificial Sequence
  Synthetic Construct
gcttttcagctagcattcattcact

SEQ ID NO: 33080 - DNA, 20 bp, Artificial Sequence
  Synthetic Construct
cccctgctgggaattcaagt

SEQ ID NO: 33081 - DNA, 23 bp, Artificial Sequence
  Synthetic Construct
tctgctttgtaccttgcaggaaa

SEQ ID NO: 33082 - DNA, 20 bp, Artificial Sequence
  Synthetic Construct
cgtgcccactccaaccttat

SEQ ID NO: 33083 - DNA, 25 bp, Artificial Sequence
  Synthetic Construct
ccagaactttgccactcttctgtca

SEQ ID NO: 33084 - DNA, 27 bp, Artificial Sequence
  Synthetic Construct
cctggctaatacatgctgtaagacact

SEQ ID NO: 33085 - DNA, 25 bp, Artificial Sequence
  Synthetic Construct
ctctccacatttggtgatcgtgttg

SEQ ID NO: 33086 - DNA, 25 bp, Artificial Sequence
  Synthetic Construct
ccaaaggtaacacaggatgttggta

SEQ ID NO: 33087 - DNA, 25 bp, Artificial Sequence
  Synthetic Construct
ggtgaagtagtgaaaggtggtaaga

SEQ ID NO: 33088 - DNA, 27 bp, Artificial Sequence
  Synthetic Construct
ggaaataatatagcctgccttgacttc

SEQ ID NO: 33089 - DNA, 26 bp, Artificial Sequence
  Synthetic Construct
cccatgggtgtattttgaaggatgaa

SEQ ID NO: 33090 - DNA, 22 bp, Artificial Sequence
  Synthetic Construct
cgtctcccaaaacgtcctcatc

SEQ ID NO: 33091 - DNA, 22 bp, Artificial Sequence
  Synthetic Construct
ggacagccacagaacgtcaact

SEQ ID NO: 33092 - DNA, 22 bp, Artificial Sequence
  Synthetic Construct
cctgcatcctgccgctctttta

SEQ ID NO: 33093 - DNA, 22 bp, Artificial Sequence
  Synthetic Construct
ggggagaattgctccagagatg

SEQ ID NO: 33094 - DNA, 22 bp, Artificial Sequence
  Synthetic Construct
ggcaggtggcagttggaaagta

SEQ ID NO: 33095 - DNA, 27 bp, Artificial Sequence
  Synthetic Construct
ccctgcttataagaccaagaggacttc

SEQ ID NO: 33096 - DNA, 22 bp, Artificial Sequence
  Synthetic Construct
cccaggggaccagcatataaca

SEQ ID NO: 33097 - DNA, 27 bp, Artificial Sequence
  Synthetic Construct
gcattcagcctccccttttgaatagta

SEQ ID NO: 33098 - DNA, 22 bp, Artificial Sequence
  Synthetic Construct
tctcgggaaatttcaggcacaa

SEQ ID NO: 33099 - DNA, 23 bp, Artificial Sequence
  Synthetic Construct
cagaagggtgcagagatacaagt

SEQ ID NO: 33100 - DNA, 22 bp, Artificial Sequence
  Synthetic Construct
aagtgctggcaagatctcagtt

SEQ ID NO: 33101 - DNA, 21 bp, Artificial Sequence
  Synthetic Construct
tcaggggctaggtgttgaact

SEQ ID NO: 33102 - DNA, 22 bp, Artificial Sequence
  Synthetic Construct
agcaatgtcctcccctatcctt

SEQ ID NO: 33103 - DNA, 23 bp, Artificial Sequence
  Synthetic Construct
aagatgaggtgcttgtctcatgt

SEQ ID NO: 33104 - DNA, 25 bp, Artificial Sequence
  Synthetic Construct
gaaatagtgagggctgtccctaaac

SEQ ID NO: 33105 - DNA, 23 bp, Artificial Sequence
  Synthetic Construct
ggaactccacacagcttttctct

SEQ ID NO: 33106 - DNA, 21 bp, Artificial Sequence
  Synthetic Construct
ttctcctgccgacctgtctac

SEQ ID NO: 33107 - DNA, 30 bp, Artificial Sequence
  Synthetic Construct
gctactatatcatccctgaccttgcattag

SEQ ID NO: 33108 - DNA, 24 bp, Artificial Sequence
  Synthetic Construct
ctctcccttaggcagtgattcttc

SEQ ID NO: 33109 - DNA, 23 bp, Artificial Sequence
  Synthetic Construct
gggagggagaaaggaggagaaac

SEQ ID NO: 33110 - DNA, 26 bp, Artificial Sequence
  Synthetic Construct
ctgtaaagagtacagtggttctctga

SEQ ID NO: 33111 - DNA, 23 bp, Artificial Sequence
  Synthetic Construct
cacccttactcttccctctgctt

SEQ ID NO: 33112 - DNA, 24 bp, Artificial Sequence
  Synthetic Construct
ctaggagagagttctagggtggtt

SEQ ID NO: 33113 - DNA, 22 bp, Artificial Sequence
  Synthetic Construct
gggacatgtgactcctccaact

SEQ ID NO: 33114 - DNA, 28 bp, Artificial Sequence
  Synthetic Construct
gtgaactcagcctcctctaaagatctaa

SEQ ID NO: 33115 - DNA, 23 bp, Artificial Sequence
  Synthetic Construct
cccttccttctcagctccatttg

SEQ ID NO: 33116 - DNA, 27 bp, Artificial Sequence
  Synthetic Construct
ggtaaagtcaggatttacacccaagtt

SEQ ID NO: 33117 - DNA, 22 bp, Artificial Sequence
  Synthetic Construct
ctgccagagggatacccatgta

SEQ ID NO: 33118 - DNA, 23 bp, Artificial Sequence
  Synthetic Construct
ttgcaacctagcagtgagaatga

SEQ ID NO: 33119 - DNA, 25 bp, Artificial Sequence
  Synthetic Construct
tgacatgttatggctcatgtctcaa

SEQ ID NO: 33120 - DNA, 22 bp, Artificial Sequence
  Synthetic Construct
ttccagccctgtcccttagtag

SEQ ID NO: 33121 - DNA, 19 bp, Artificial Sequence
  Synthetic Construct
acacccactctgggcatgt

SEQ ID NO: 33122 - DNA, 19 bp, Artificial Sequence
  Synthetic Construct
ttgcctccaccatgccaaa

SEQ ID NO: 33123 - DNA, 23 bp, Artificial Sequence
  Synthetic Construct
ctgagcctccaagtcctcatttc

SEQ ID NO: 33124 - DNA, 26 bp, Artificial Sequence
  Synthetic Construct
ttgagaaagagggaagagtctaggat

SEQ ID NO: 33125 - DNA, 23 bp, Artificial Sequence
  Synthetic Construct
agaggcacacttgaaaagactga

SEQ ID NO: 33126 - DNA, 23 bp, Artificial Sequence
  Synthetic Construct
cacccacacacattctaccttga

SEQ ID NO: 33127 - DNA, 21 bp, Artificial Sequence
  Synthetic Construct
tactgctggcggtgaggatgt

SEQ ID NO: 33128 - DNA, 26 bp, Artificial Sequence
  Synthetic Construct
gtgagcaaggtataggagatgaaaga

SEQ ID NO: 33129 - DNA, 27 bp, Artificial Sequence
  Synthetic Construct
tgcactcctttccctatctccttatta

SEQ ID NO: 33130 - DNA, 26 bp, Artificial Sequence
  Synthetic Construct
gggcaatagccccaaggtatattttc

SEQ ID NO: 33131 - DNA, 24 bp, Artificial Sequence
  Synthetic Construct
tcacttcagcaaaacatgcctaag

SEQ ID NO: 33132 - DNA, 26 bp, Artificial Sequence
  Synthetic Construct
gaccagcatataagagggtcatgaat

SEQ ID NO: 33133 - DNA, 24 bp, Artificial Sequence
  Synthetic Construct
ctggaacattaagcagctcaccta

SEQ ID NO: 33134 - DNA, 22 bp, Artificial Sequence
  Synthetic Construct
aggggtctgggagggaagataa

SEQ ID NO: 33135 - DNA, 22 bp, Artificial Sequence
  Synthetic Construct
gggtcaggggaaggtcactaat

SEQ ID NO: 33136 - DNA, 26 bp, Artificial Sequence
  Synthetic Construct
tctctttatctcaggccatgtagtca

SEQ ID NO: 33137 - DNA, 24 bp, Artificial Sequence
  Synthetic Construct
ggttaccaagggcagtttgagagt

SEQ ID NO: 33138 - DNA, 25 bp, Artificial Sequence
  Synthetic Construct
ccgatattccctccctttattggtt

SEQ ID NO: 33139 - DNA, 21 bp, Artificial Sequence
  Synthetic Construct
agggccacatggctcttctgt

SEQ ID NO: 33140 - DNA, 21 bp, Artificial Sequence
  Synthetic Construct
tggctggcaattctgatgcaa

SEQ ID NO: 33141 - DNA, 21 bp, Artificial Sequence
  Synthetic Construct
tcaggcgcagaactctcaatg

SEQ ID NO: 33142 - DNA, 25 bp, Artificial Sequence
  Synthetic Construct
gtgaaaagctatgccctggagaaca

SEQ ID NO: 33143 - DNA, 24 bp, Artificial Sequence
  Synthetic Construct
cacagagtaggtgctcgtgaagtt

SEQ ID NO: 33144 - DNA, 27 bp, Artificial Sequence
  Synthetic Construct
gagatgcatattcagggagcagtaaac

SEQ ID NO: 33145 - DNA, 26 bp, Artificial Sequence
  Synthetic Construct
ctatgaacttgagtgggagagacatt

SEQ ID NO: 33146 - DNA, 22 bp, Artificial Sequence
  Synthetic Construct
gcagttttgacttggccagcta

SEQ ID NO: 33147 - DNA, 22 bp, Artificial Sequence
  Synthetic Construct
aacaacacaggggctttgtttc

SEQ ID NO: 33148 - DNA, 24 bp, Artificial Sequence
  Synthetic Construct
gacttcagtctgcccattggtgat

SEQ ID NO: 33149 - DNA, 26 bp, Artificial Sequence
  Synthetic Construct
catcacactctgggtacactttgatt

SEQ ID NO: 33150 - DNA, 19 bp, Artificial Sequence
  Synthetic Construct
agcctcagccgagccaagt

SEQ ID NO: 33151 - DNA, 24 bp, Artificial Sequence
  Synthetic Construct
gacccagaaaagggaagggactta

SEQ ID NO: 33152 - DNA, 24 bp, Artificial Sequence
  Synthetic Construct
cttttgcagtaccctaggcacata

SEQ ID NO: 33153 - DNA, 24 bp, Artificial Sequence
  Synthetic Construct
gacacaggtagtccgcagtctaag

SEQ ID NO: 33154 - DNA, 22 bp, Artificial Sequence
  Synthetic Construct
tgtcctcacactatgcccagta

SEQ ID NO: 33155 - DNA, 29 bp, Artificial Sequence
  Synthetic Construct
gtatagaaagggtagagactgtggataac

SEQ ID NO: 33156 - DNA, 21 bp, Artificial Sequence
  Synthetic Construct
ggtggggcctcttcctaacaa

SEQ ID NO: 33157 - DNA, 20 bp, Artificial Sequence
  Synthetic Construct
gcccactgaagagcatcgta

SEQ ID NO: 33158 - DNA, 23 bp, Artificial Sequence
  Synthetic Construct
cccctcactccatacagcacaga

SEQ ID NO: 33159 - DNA, 26 bp, Artificial Sequence
  Synthetic Construct
gctgtacatagggatgtgagtgaaag

SEQ ID NO: 33160 - DNA, 23 bp, Artificial Sequence
  Synthetic Construct
cagatcccaagaggaggggaaat

SEQ ID NO: 33161 - DNA, 20 bp, Artificial Sequence
  Synthetic Construct
aggccaactcctcagctcat

SEQ ID NO: 33162 - DNA, 24 bp, Artificial Sequence
  Synthetic Construct
tgttttctctccactccatgtcaa

SEQ ID NO: 33163 - DNA, 22 bp, Artificial Sequence
  Synthetic Construct
ccttgcattggccattggcttt

SEQ ID NO: 33164 - DNA, 26 bp, Artificial Sequence
  Synthetic Construct
cgtttctgacagagaaagaggtgcta

SEQ ID NO: 33165 - DNA, 26 bp, Artificial Sequence
  Synthetic Construct
gagagaatccaggtaacaaaccaatg

SEQ ID NO: 33166 - DNA, 24 bp, Artificial Sequence
  Synthetic Construct
tcacaaagtttggccatcagaaga

SEQ ID NO: 33167 - DNA, 25 bp, Artificial Sequence
  Synthetic Construct
gggtgagtagaaggaaccgatgaca

SEQ ID NO: 33168 - DNA, 22 bp, Artificial Sequence
  Synthetic Construct
gcagggaagggaatccaacagt

SEQ ID NO: 33169 - DNA, 23 bp, Artificial Sequence
  Synthetic Construct
acagtctgaccccattttgtctt

SEQ ID NO: 33170 - DNA, 24 bp, Artificial Sequence
  Synthetic Construct
ccattattcctgcaacgctctttc

SEQ ID NO: 33171 - DNA, 22 bp, Artificial Sequence
  Synthetic Construct
gggccttgcatggctaactttg

SEQ ID NO: 33172 - DNA, 28 bp, Artificial Sequence
  Synthetic Construct
cagacaacttgttcctgggaaacaaaag

SEQ ID NO: 33173 - DNA, 21 bp, Artificial Sequence
  Synthetic Construct
agcgaggacaccctggtcaaa

SEQ ID NO: 33174 - DNA, 24 bp, Artificial Sequence
  Synthetic Construct
cctctgccagtataggcagtctct

SEQ ID NO: 33175 - DNA, 22 bp, Artificial Sequence
  Synthetic Construct
tccagtagggctctgaccaaca

SEQ ID NO: 33176 - DNA, 24 bp, Artificial Sequence
  Synthetic Construct
ctgccccaatgggttaacagagat

SEQ ID NO: 33177 - DNA, 24 bp, Artificial Sequence
  Synthetic Construct
gttgaatacgcagtaccctacgtt

SEQ ID NO: 33178 - DNA, 23 bp, Artificial Sequence
  Synthetic Construct
acacgtagagtgcaaggaatcat

SEQ ID NO: 33179 - DNA, 26 bp, Artificial Sequence
  Synthetic Construct
cacagctgaaactaccagagaaacta

SEQ ID NO: 33180 - DNA, 25 bp, Artificial Sequence
  Synthetic Construct
cgtagtaatcaggtgcagccaatag

SEQ ID NO: 33181 - DNA, 23 bp, Artificial Sequence
  Synthetic Construct
gcagtagccagagagtggttaca

SEQ ID NO: 33182 - DNA, 20 bp, Artificial Sequence
  Synthetic Construct
aggggttccaccaccagatg

SEQ ID NO: 33183 - DNA, 25 bp, Artificial Sequence
  Synthetic Construct
gccagagagggctacatgcagtaat

SEQ ID NO: 33184 - DNA, 23 bp, Artificial Sequence
  Synthetic Construct
actacgtgagtatgaggcacaag

SEQ ID NO: 33185 - DNA, 25 bp, Artificial Sequence
  Synthetic Construct
gaactccttatgagctttgccttgt

SEQ ID NO: 33186 - DNA, 21 bp, Artificial Sequence
  Synthetic Construct
gcagaccaaagcggcaagaag

SEQ ID NO: 33187 - DNA, 24 bp, Artificial Sequence
  Synthetic Construct
ctttgcatgggaatgttcctcttt

SEQ ID NO: 33188 - DNA, 21 bp, Artificial Sequence
  Synthetic Construct
acgtgaagagggcctgagact

SEQ ID NO: 33189 - DNA, 21 bp, Artificial Sequence
  Synthetic Construct
accagtcgtcagggagtcgaa

SEQ ID NO: 33190 - DNA, 19 bp, Artificial Sequence
  Synthetic Construct
tgcccagtcccctgctttc

SEQ ID NO: 33191 - DNA, 23 bp, Artificial Sequence
  Synthetic Construct
cgttataacctgggcttccacaa

SEQ ID NO: 33192 - DNA, 25 bp, Artificial Sequence
  Synthetic Construct
acaaggaaagttacttggagtcctt

SEQ ID NO: 33193 - DNA, 21 bp, Artificial Sequence
  Synthetic Construct
gggaaagaaggcacaggtaca

SEQ ID NO: 33194 - DNA, 23 bp, Artificial Sequence
  Synthetic Construct
ccaggcaggacatgatacacaca

SEQ ID NO: 33195 - DNA, 23 bp, Artificial Sequence
  Synthetic Construct
gaaaaactgcaggctgacagaga

SEQ ID NO: 33196 - DNA, 23 bp, Artificial Sequence
  Synthetic Construct
cgcgaggaaacttggcttgtgtt

SEQ ID NO: 33197 - DNA, 27 bp, Artificial Sequence
  Synthetic Construct
cttcctaggaggaaaaataggccataa

SEQ ID NO: 33198 - DNA, 21 bp, Artificial Sequence
  Synthetic Construct
ctgtgaagcagtcagggcaaa

SEQ ID NO: 33199 - DNA, 24 bp, Artificial Sequence
  Synthetic Construct
ggcctgatgcaaggatgtaacaca

SEQ ID NO: 33200 - DNA, 23 bp, Artificial Sequence
  Synthetic Construct
ccccatgtaggaggactgaggat

SEQ ID NO: 33201 - DNA, 24 bp, Artificial Sequence
  Synthetic Construct
gacatcagtcaccctctctttcaa

SEQ ID NO: 33202 - DNA, 26 bp, Artificial Sequence
  Synthetic Construct
cactgaaggagaggcaagacagaaat

SEQ ID NO: 33203 - DNA, 23 bp, Artificial Sequence
  Synthetic Construct
gattaggaagggctttggcattg

SEQ ID NO: 33204 - DNA, 24 bp, Artificial Sequence
  Synthetic Construct
catggttaaggcagcaaagtgtaa

SEQ ID NO: 33205 - DNA, 25 bp, Artificial Sequence
  Synthetic Construct
gttggtagggactcttgaagttttg

SEQ ID NO: 33206 - DNA, 22 bp, Artificial Sequence
  Synthetic Construct
cacaggagagtctgggttgact

SEQ ID NO: 33207 - DNA, 19 bp, Artificial Sequence
  Synthetic Construct
ggccagaactgggccgaaa

SEQ ID NO: 33208 - DNA, 23 bp, Artificial Sequence
  Synthetic Construct
ggatgggtacagttggagaacaa

SEQ ID NO: 33209 - DNA, 22 bp, Artificial Sequence
  Synthetic Construct
agaccaactggctacctgatgt

SEQ ID NO: 33210 - DNA, 22 bp, Artificial Sequence
  Synthetic Construct
ggctaagaggagcagtgaccat

SEQ ID NO: 33211 - DNA, 22 bp, Artificial Sequence
  Synthetic Construct
ggtgctcaggggagtgagaaaa

SEQ ID NO: 33212 - DNA, 26 bp, Artificial Sequence
  Synthetic Construct
gagaatgtgaacaggggaaataggaa

SEQ ID NO: 33213 - DNA, 25 bp, Artificial Sequence
  Synthetic Construct
acttcaaagtgtatgacgcttgcta

SEQ ID NO: 33214 - DNA, 24 bp, Artificial Sequence
  Synthetic Construct
gctgggctagattagccattcaac

SEQ ID NO: 33215 - DNA, 18 bp, Artificial Sequence
  Synthetic Construct
tggcagctccagcgaatc

SEQ ID NO: 33216 - DNA, 25 bp, Artificial Sequence
  Synthetic Construct
ctcctcaactcctcactaggaactt

SEQ ID NO: 33217 - DNA, 22 bp, Artificial Sequence
  Synthetic Construct
gggaagggcagcagacatcttt

SEQ ID NO: 33218 - DNA, 26 bp, Artificial Sequence
  Synthetic Construct
ggcctgtgattatgtcagaagggttt

SEQ ID NO: 33219 - DNA, 27 bp, Artificial Sequence
  Synthetic Construct
gggaatacaattggagtcagtggaaag

SEQ ID NO: 33220 - DNA, 26 bp, Artificial Sequence
  Synthetic Construct
gaggaaagaccttgtctgttcaggta

SEQ ID NO: 33221 - DNA, 22 bp, Artificial Sequence
  Synthetic Construct
gccacctggcagagagatgaaa

SEQ ID NO: 33222 - DNA, 28 bp, Artificial Sequence
  Synthetic Construct
ggaggcaagttaaaaacgtgactaggaa

SEQ ID NO: 33223 - DNA, 24 bp, Artificial Sequence
  Synthetic Construct
gctaggctgctattgcagtagttc

SEQ ID NO: 33224 - DNA, 24 bp, Artificial Sequence
  Synthetic Construct
ccccatttgaccctctttttcaga

SEQ ID NO: 33225 - DNA, 21 bp, Artificial Sequence
  Synthetic Construct
ttgggctcctgcctgcacaac

SEQ ID NO: 33226 - DNA, 20 bp, Artificial Sequence
  Synthetic Construct
tgggaggaggcgcgagacta

SEQ ID NO: 33227 - DNA, 22 bp, Artificial Sequence
  Synthetic Construct
acccacaagcctcaaccatttc

SEQ ID NO: 33228 - DNA, 21 bp, Artificial Sequence
  Synthetic Construct
ggcacacctgtgttctgttga

SEQ ID NO: 33229 - DNA, 23 bp, Artificial Sequence
  Synthetic Construct
gccacaacctcctgtttgagaga

SEQ ID NO: 33230 - DNA, 23 bp, Artificial Sequence
  Synthetic Construct
gtttcctgcttggacttgactga

SEQ ID NO: 33231 - DNA, 26 bp, Artificial Sequence
  Synthetic Construct
gacactattaaccaccaccgttcctt

SEQ ID NO: 33232 - DNA, 25 bp, Artificial Sequence
  Synthetic Construct
ccatcccatccgtccaatacgttag

SEQ ID NO: 33233 - DNA, 22 bp, Artificial Sequence
  Synthetic Construct
ggagcagctagaagctgaacaa

SEQ ID NO: 33234 - DNA, 25 bp, Artificial Sequence
  Synthetic Construct
cccctttcctaaggtagaggagtct

SEQ ID NO: 33235 - DNA, 26 bp, Artificial Sequence
  Synthetic Construct
gggtttcagaaagttagagccattca

SEQ ID NO: 33236 - DNA, 25 bp, Artificial Sequence
  Synthetic Construct
ggaaatggatcatcagcagaagcaa

SEQ ID NO: 33237 - DNA, 25 bp, Artificial Sequence
  Synthetic Construct
acagcattggccttatttccaaaag

SEQ ID NO: 33238 - DNA, 22 bp, Artificial Sequence
  Synthetic Construct
ggctctctgcgcatcagaagaa

SEQ ID NO: 33239 - DNA, 23 bp, Artificial Sequence
  Synthetic Construct
gcatggtcttgtctagggaggaa

SEQ ID NO: 33240 - DNA, 29 bp, Artificial Sequence
  Synthetic Construct
ggagcaggacctattattagtcttcgatt

SEQ ID NO: 33241 - DNA, 24 bp, Artificial Sequence
  Synthetic Construct
caggacattcctcctcctcagaca

SEQ ID NO: 33242 - DNA, 22 bp, Artificial Sequence
  Synthetic Construct
caccacatcaaggctctaccat

SEQ ID NO: 33243 - DNA, 22 bp, Artificial Sequence
  Synthetic Construct
gggcaggaggcattcatcaact

SEQ ID NO: 33244 - DNA, 28 bp, Artificial Sequence
  Synthetic Construct
cctggtagtcttaaacaggaatctctca

SEQ ID NO: 33245 - DNA, 20 bp, Artificial Sequence
  Synthetic Construct
ggagctgctgtgttggagtt

SEQ ID NO: 33246 - DNA, 27 bp, Artificial Sequence
  Synthetic Construct
ctcagcgaagtttaaagcacatcattc

SEQ ID NO: 33247 - DNA, 25 bp, Artificial Sequence
  Synthetic Construct
gaacctctcttcccagagattgaaa

SEQ ID NO: 33248 - DNA, 25 bp, Artificial Sequence
  Synthetic Construct
tcttccttagcaccatggtagagat

SEQ ID NO: 33249 - DNA, 25 bp, Artificial Sequence
  Synthetic Construct
ggaaaccaaagctctccagtaagtt

SEQ ID NO: 33250 - DNA, 24 bp, Artificial Sequence
  Synthetic Construct
gctttatgagggtagggcttttca

SEQ ID NO: 33251 - DNA, 23 bp, Artificial Sequence
  Synthetic Construct
agtccacatctcccttgaagaca

SEQ ID NO: 33252 - DNA, 23 bp, Artificial Sequence
  Synthetic Construct
agggtggggaaagataaatgcaa

SEQ ID NO: 33253 - DNA, 23 bp, Artificial Sequence
  Synthetic Construct
tgcagaccatcacacatctcaac

SEQ ID NO: 33254 - DNA, 24 bp, Artificial Sequence
  Synthetic Construct
cagacactaagccaagctctgaag

SEQ ID NO: 33255 - DNA, 23 bp, Artificial Sequence
  Synthetic Construct
caagagccccaagtaatgtgtgt

SEQ ID NO: 33256 - DNA, 24 bp, Artificial Sequence
  Synthetic Construct
ccccaccttaaaggcacagagtag

SEQ ID NO: 33257 - DNA, 20 bp, Artificial Sequence
  Synthetic Construct
ggtggggagaggcaggattg

SEQ ID NO: 33258 - DNA, 22 bp, Artificial Sequence
  Synthetic Construct
aaatgtgtgtttgcgtgtggaa

SEQ ID NO: 33259 - DNA, 22 bp, Artificial Sequence
  Synthetic Construct
ggcctaaacgctgctcacctat

SEQ ID NO: 33260 - DNA, 21 bp, Artificial Sequence
  Synthetic Construct
ggaaaccggcatttggacaca

SEQ ID NO: 33261 - DNA, 23 bp, Artificial Sequence
  Synthetic Construct
gtgactgtggcttcagagtgatg

SEQ ID NO: 33262 - DNA, 24 bp, Artificial Sequence
  Synthetic Construct
gagcacaaaaggtaggagtgagaa

SEQ ID NO: 33263 - DNA, 24 bp, Artificial Sequence
  Synthetic Construct
tcataacgtggaggagaactgttg

SEQ ID NO: 33264 - DNA, 25 bp, Artificial Sequence
  Synthetic Construct
gcctaaaactttcatggggtgtttg

SEQ ID NO: 33265 - DNA, 22 bp, Artificial Sequence
  Synthetic Construct
acagacctcaagctcgctcaga

SEQ ID NO: 33266 - DNA, 19 bp, Artificial Sequence
  Synthetic Construct
agcctggggccttgtctga

SEQ ID NO: 33267 - DNA, 22 bp, Artificial Sequence
  Synthetic Construct
cactggaacatgacctgtgaga

SEQ ID NO: 33268 - DNA, 24 bp, Artificial Sequence
  Synthetic Construct
gacgtttaggtttccatggccaaa

SEQ ID NO: 33269 - DNA, 21 bp, Artificial Sequence
  Synthetic Construct
tcccaggagaggaaggccaat

SEQ ID NO: 33270 - DNA, 24 bp, Artificial Sequence
  Synthetic Construct
ctccttagggtggcatacacaaac

SEQ ID NO: 33271 - DNA, 25 bp, Artificial Sequence
  Synthetic Construct
cagagaaggaatccctgctatcaaa

SEQ ID NO: 33272 - DNA, 25 bp, Artificial Sequence
  Synthetic Construct
ggtttgagaggcacctagaatcact

SEQ ID NO: 33273 - DNA, 21 bp, Artificial Sequence
  Synthetic Construct
gtgtgaaagccaggtgagcat

SEQ ID NO: 33274 - DNA, 24 bp, Artificial Sequence
  Synthetic Construct
ggaccacaatcttcatgagagcaa

SEQ ID NO: 33275 - DNA, 27 bp, Artificial Sequence
  Synthetic Construct
ctcattagatgccttcgtcttttcagt

SEQ ID NO: 33276 - DNA, 26 bp, Artificial Sequence
  Synthetic Construct
gtattggccgtaggtttattgacttc

SEQ ID NO: 33277 - DNA, 22 bp, Artificial Sequence
  Synthetic Construct
ccagatagtggccagattgctt

SEQ ID NO: 33278 - DNA, 22 bp, Artificial Sequence
  Synthetic Construct
agtaggcagcaacagttgtcat

SEQ ID NO: 33279 - DNA, 20 bp, Artificial Sequence
  Synthetic Construct
tctccagcactggctcagat

SEQ ID NO: 33280 - DNA, 24 bp, Artificial Sequence
  Synthetic Construct
atgtcaagacagcctaggttcaaa

SEQ ID NO: 33281 - DNA, 22 bp, Artificial Sequence
  Synthetic Construct
tggagggagctgcttctagctt

SEQ ID NO: 33282 - DNA, 19 bp, Artificial Sequence
  Synthetic Construct
cgtgaccggccaacactga

SEQ ID NO: 33283 - DNA, 20 bp, Artificial Sequence
  Synthetic Construct
tgctgtggttgggtcccatt

SEQ ID NO: 33284 - DNA, 24 bp, Artificial Sequence
  Synthetic Construct
gtgaaatccctgaagtgtttgctt

SEQ ID NO: 33285 - DNA, 23 bp, Artificial Sequence
  Synthetic Construct
agggtaaatgggagtgcttctct

SEQ ID NO: 33286 - DNA, 22 bp, Artificial Sequence
  Synthetic Construct
gcagctggtcaggagataaagt

SEQ ID NO: 33287 - DNA, 21 bp, Artificial Sequence
  Synthetic Construct
cgctggcttccagaagggttt

SEQ ID NO: 33288 - DNA, 24 bp, Artificial Sequence
  Synthetic Construct
tgggtctcttgaagacagaagatg

SEQ ID NO: 33289 - DNA, 27 bp, Artificial Sequence
  Synthetic Construct
ctctgagaagacgtgtctcatttccaa

SEQ ID NO: 33290 - DNA, 21 bp, Artificial Sequence
  Synthetic Construct
ccctcttcagctaggcacaca

SEQ ID NO: 33291 - DNA, 21 bp, Artificial Sequence
  Synthetic Construct
atcggccctcctcacctttca

SEQ ID NO: 33292 - DNA, 22 bp, Artificial Sequence
  Synthetic Construct
cccaggcccatgactactcctt

SEQ ID NO: 33293 - DNA, 26 bp, Artificial Sequence
  Synthetic Construct
ccttaaggattcagccctcttctaaa

SEQ ID NO: 33294 - DNA, 25 bp, Artificial Sequence
  Synthetic Construct
ccctcccttccctctaaatagactt

SEQ ID NO: 33295 - DNA, 24 bp, Artificial Sequence
  Synthetic Construct
gtccaggaagactggagcctagaa

SEQ ID NO: 33296 - DNA, 26 bp, Artificial Sequence
  Synthetic Construct
ggcttctggttttggaaacaggttga

SEQ ID NO: 33297 - DNA, 22 bp, Artificial Sequence
  Synthetic Construct
ggggctttgtactcacaagtca

SEQ ID NO: 33298 - DNA, 20 bp, Artificial Sequence
  Synthetic Construct
ccttgcgcttggcattggtt

SEQ ID NO: 33299 - DNA, 24 bp, Artificial Sequence
  Synthetic Construct
cagaggacactgacaatcaagtca

SEQ ID NO: 33300 - DNA, 24 bp, Artificial Sequence
  Synthetic Construct
cctgaccagggtacagtcactaag

SEQ ID NO: 33301 - DNA, 22 bp, Artificial Sequence
  Synthetic Construct
cagcaaccaagccaatcctgaa

SEQ ID NO: 33302 - DNA, 28 bp, Artificial Sequence
  Synthetic Construct
gggtaaaggtgggagagaagagagtttc

SEQ ID NO: 33303 - DNA, 23 bp, Artificial Sequence
  Synthetic Construct
tgtaaaagtggccagtctgttct

SEQ ID NO: 33304 - DNA, 19 bp, Artificial Sequence
  Synthetic Construct
aggcagagcagctccacaa

SEQ ID NO: 33305 - DNA, 21 bp, Artificial Sequence
  Synthetic Construct
ggtgcttgaagtgggcttttc

SEQ ID NO: 33306 - DNA, 21 bp, Artificial Sequence
  Synthetic Construct
ggccagttcgctaccaaggaa

SEQ ID NO: 33307 - DNA, 20 bp, Artificial Sequence
  Synthetic Construct
cacctcagcctcctgcatag

SEQ ID NO: 33308 - DNA, 22 bp, Artificial Sequence
  Synthetic Construct
agtagtccccaaccagcagaga

SEQ ID NO: 33309 - DNA, 30 bp, Artificial Sequence
  Synthetic Construct
cctcttcttcatcctggttaatttggaagt

SEQ ID NO: 33310 - DNA, 24 bp, Artificial Sequence
  Synthetic Construct
agacgaaggctcaatgtagacaag

SEQ ID NO: 33311 - DNA, 23 bp, Artificial Sequence
  Synthetic Construct
cgtctgtcacagttaacggcaaa

SEQ ID NO: 33312 - DNA, 20 bp, Artificial Sequence
  Synthetic Construct
tccacacctgcggccaaaat

SEQ ID NO: 33313 - DNA, 18 bp, Artificial Sequence
  Synthetic Construct
tgctgggcccatgtgctt

SEQ ID NO: 33314 - DNA, 19 bp, Artificial Sequence
  Synthetic Construct
tgctgggtgccaggacatc

SEQ ID NO: 33315 - DNA, 25 bp, Artificial Sequence
  Synthetic Construct
ctgcagaagacctacaggtaacatc

SEQ ID NO: 33316 - DNA, 20 bp, Artificial Sequence
  Synthetic Construct
gccctgtggcatggtcattt

SEQ ID NO: 33317 - DNA, 24 bp, Artificial Sequence
  Synthetic Construct
gtgagaggaaatcttgggctatga

SEQ ID NO: 33318 - DNA, 22 bp, Artificial Sequence
  Synthetic Construct
ggagcaaggcacagttttcaga

SEQ ID NO: 33319 - DNA, 21 bp, Artificial Sequence
  Synthetic Construct
gccctttaagccaaccctaca

SEQ ID NO: 33320 - DNA, 19 bp, Artificial Sequence
  Synthetic Construct
gcccagccactggtgaact

SEQ ID NO: 33321 - DNA, 20 bp, Artificial Sequence
  Synthetic Construct
ttgtcaccaccgggcacatt

SEQ ID NO: 33322 - DNA, 22 bp, Artificial Sequence
  Synthetic Construct
gcggagcagatgtgatgcctat

SEQ ID NO: 33323 - DNA, 23 bp, Artificial Sequence
  Synthetic Construct
caatctcacccaaacctgcttct

SEQ ID NO: 33324 - DNA, 23 bp, Artificial Sequence
  Synthetic Construct
ccccgtacccaatgaggagctat

SEQ ID NO: 33325 - DNA, 25 bp, Artificial Sequence
  Synthetic Construct
acagaaagtgtgtgcttcactgata

SEQ ID NO: 33326 - DNA, 24 bp, Artificial Sequence
  Synthetic Construct
cagtgcaagaacactgaagactca

SEQ ID NO: 33327 - DNA, 24 bp, Artificial Sequence
  Synthetic Construct
actgatctcccagtcagggtcaag

SEQ ID NO: 33328 - DNA, 22 bp, Artificial Sequence
  Synthetic Construct
cgagccctgctgcttcacatta

SEQ ID NO: 33329 - DNA, 22 bp, Artificial Sequence
  Synthetic Construct
cccgaggctcctccggttatta

SEQ ID NO: 33330 - DNA, 22 bp, Artificial Sequence
  Synthetic Construct
cccagaggacctcacacctcat

SEQ ID NO: 33331 - DNA, 23 bp, Artificial Sequence
  Synthetic Construct
cactctgaatgtgaggctgtagt

SEQ ID NO: 33332 - DNA, 22 bp, Artificial Sequence
  Synthetic Construct
gttcagcaaggtgtgcttctgt

SEQ ID NO: 33333 - DNA, 19 bp, Artificial Sequence
  Synthetic Construct
tggagggccagtgggatgt

SEQ ID NO: 33334 - DNA, 23 bp, Artificial Sequence
  Synthetic Construct
gcatcaccaagagtctcccttgt

SEQ ID NO: 33335 - DNA, 26 bp, Artificial Sequence
  Synthetic Construct
ggacagggtggatactgtgtttgtag

SEQ ID NO: 33336 - DNA, 24 bp, Artificial Sequence
  Synthetic Construct
cttagcacagagtaaacccacaca

SEQ ID NO: 33337 - DNA, 23 bp, Artificial Sequence
  Synthetic Construct
ccctcccaaacctggactgttct

SEQ ID NO: 33338 - DNA, 23 bp, Artificial Sequence
  Synthetic Construct
cccctccccgcaggacttaaata

SEQ ID NO: 33339 - DNA, 28 bp, Artificial Sequence
  Synthetic Construct
cagacccaaaccatatcaccttcttttc

SEQ ID NO: 33340 - DNA, 24 bp, Artificial Sequence
  Synthetic Construct
gggtcagtctgtagagtccgtttc

SEQ ID NO: 33341 - DNA, 18 bp, Artificial Sequence
  Synthetic Construct
tagcagggcccagagcaa

SEQ ID NO: 33342 - DNA, 26 bp, Artificial Sequence
  Synthetic Construct
ctgcagacattctgtgtactgtgaga

SEQ ID NO: 33343 - DNA, 23 bp, Artificial Sequence
  Synthetic Construct
aagtgtggtcttcatggttccaa

SEQ ID NO: 33344 - DNA, 22 bp, Artificial Sequence
  Synthetic Construct
gtgcccacagagggagcattta

SEQ ID NO: 33345 - DNA, 25 bp, Artificial Sequence
  Synthetic Construct
gcacaattttcagcaaggagagatg

SEQ ID NO: 33346 - DNA, 23 bp, Artificial Sequence
  Synthetic Construct
ctgtgagcatctagggtcacgat

SEQ ID NO: 33347 - DNA, 24 bp, Artificial Sequence
  Synthetic Construct
cacaatggtcccagacagaagcaa

SEQ ID NO: 33348 - DNA, 25 bp, Artificial Sequence
  Synthetic Construct
gtgcccatactacccaaagcaatac

SEQ ID NO: 33349 - DNA, 19 bp, Artificial Sequence
  Synthetic Construct
tgggcagggtacccagtga

SEQ ID NO: 33350 - DNA, 22 bp, Artificial Sequence
  Synthetic Construct
cattttccctgggctacactct

SEQ ID NO: 33351 - DNA, 25 bp, Artificial Sequence
  Synthetic Construct
ggtggtgatgaatgatggacatact

SEQ ID NO: 33352 - DNA, 25 bp, Artificial Sequence
  Synthetic Construct
tctgaagatttcacgacaggaagaa

SEQ ID NO: 33353 - DNA, 24 bp, Artificial Sequence
  Synthetic Construct
gaaccacaaacctttggaatggaa

SEQ ID NO: 33354 - DNA, 25 bp, Artificial Sequence
  Synthetic Construct
gctctgctagcaaactgtgcttgtt

SEQ ID NO: 33355 - DNA, 20 bp, Artificial Sequence
  Synthetic Construct
accaggtaggaggctgcttt

SEQ ID NO: 33356 - DNA, 25 bp, Artificial Sequence
  Synthetic Construct
ggggaaggatggaggtattaagtga

SEQ ID NO: 33357 - DNA, 20 bp, Artificial Sequence
  Synthetic Construct
tcgagaggaaagggctgtgt

SEQ ID NO: 33358 - DNA, 20 bp, Artificial Sequence
  Synthetic Construct
aaggccaggtcacctacaga

SEQ ID NO: 33359 - DNA, 20 bp, Artificial Sequence
  Synthetic Construct
tgtgcccaggcctaaactgt

SEQ ID NO: 33360 - DNA, 20 bp, Artificial Sequence
  Synthetic Construct
agcctccagctacccggaat

SEQ ID NO: 33361 - DNA, 21 bp, Artificial Sequence
  Synthetic Construct
gtgtggtgaggaccatggatt

SEQ ID NO: 33362 - DNA, 19 bp, Artificial Sequence
  Synthetic Construct
gggagggcttcccacaaag

SEQ ID NO: 33363 - DNA, 24 bp, Artificial Sequence
  Synthetic Construct
ccccgtagagaactgtctcacatc

SEQ ID NO: 33364 - DNA, 25 bp, Artificial Sequence
  Synthetic Construct
actcaaaatgcagcctagatagcaa

SEQ ID NO: 33365 - DNA, 27 bp, Artificial Sequence
  Synthetic Construct
gcagctaccagatagacttagctgtaa

SEQ ID NO: 33366 - DNA, 29 bp, Artificial Sequence
  Synthetic Construct
gacagaaccccttgtataacaatcagact

SEQ ID NO: 33367 - DNA, 21 bp, Artificial Sequence
  Synthetic Construct
gtccaggcagagccatacatc

SEQ ID NO: 33368 - DNA, 21 bp, Artificial Sequence
  Synthetic Construct
tagggccaagagctcctgcaa

SEQ ID NO: 33369 - DNA, 27 bp, Artificial Sequence
  Synthetic Construct
gaagccatgcagaaaacatttccttac

SEQ ID NO: 33370 - DNA, 21 bp, Artificial Sequence
  Synthetic Construct
cctgccccgcctccatattta

SEQ ID NO: 33371 - DNA, 26 bp, Artificial Sequence
  Synthetic Construct
gtggaaatagaagctcactctcaact

SEQ ID NO: 33372 - DNA, 22 bp, Artificial Sequence
  Synthetic Construct
caacacaccaatgcagccaatc

SEQ ID NO: 33373 - DNA, 24 bp, Artificial Sequence
  Synthetic Construct
cctgcagagttattgggaagatga

SEQ ID NO: 33374 - DNA, 21 bp, Artificial Sequence
  Synthetic Construct
tgggcagcacgtcacagaatc

SEQ ID NO: 33375 - DNA, 20 bp, Artificial Sequence
  Synthetic Construct
agcaggctgggccaaaatca

SEQ ID NO: 33376 - DNA, 23 bp, Artificial Sequence
  Synthetic Construct
cacttgcgaaggaatcaccatca

SEQ ID NO: 33377 - DNA, 22 bp, Artificial Sequence
  Synthetic Construct
tggtggagcagtcacctcttct

SEQ ID NO: 33378 - DNA, 21 bp, Artificial Sequence
  Synthetic Construct
gcctggctttgcagagctttt

SEQ ID NO: 33379 - DNA, 24 bp, Artificial Sequence
  Synthetic Construct
agggcctttacaaaagagtcttga

SEQ ID NO: 33380 - DNA, 22 bp, Artificial Sequence
  Synthetic Construct
cagcccaggaccctcttttgat

SEQ ID NO: 33381 - DNA, 23 bp, Artificial Sequence
  Synthetic Construct
gcaggatatgagtgatgctccat

SEQ ID NO: 33382 - DNA, 19 bp, Artificial Sequence
  Synthetic Construct
gccgccatctctgaactgt

SEQ ID NO: 33383 - DNA, 25 bp, Artificial Sequence
  Synthetic Construct
gtcataactacatggctggaaccta

SEQ ID NO: 33384 - DNA, 27 bp, Artificial Sequence
  Synthetic Construct
accatggactaatgaaatctggctatg

SEQ ID NO: 33385 - DNA, 20 bp, Artificial Sequence
  Synthetic Construct
atccacagccagccatcaag

SEQ ID NO: 33386 - DNA, 27 bp, Artificial Sequence
  Synthetic Construct
gagtgctcactcagcatatctgctatc

SEQ ID NO: 33387 - DNA, 22 bp, Artificial Sequence
  Synthetic Construct
ttctggggacacctgatagaca

SEQ ID NO: 33388 - DNA, 24 bp, Artificial Sequence
  Synthetic Construct
agcaaaaataccgaggtagccaat

SEQ ID NO: 33389 - DNA, 24 bp, Artificial Sequence
  Synthetic Construct
gcccaataggtgtgaaactttgaa

SEQ ID NO: 33390 - DNA, 25 bp, Artificial Sequence
  Synthetic Construct
ggataggcaagtactggctaaaagt

SEQ ID NO: 33391 - DNA, 24 bp, Artificial Sequence
  Synthetic Construct
cccctaccatgactgatgaagaaa

SEQ ID NO: 33392 - DNA, 23 bp, Artificial Sequence
  Synthetic Construct
ggctgagcccatggagttaagat

SEQ ID NO: 33393 - DNA, 23 bp, Artificial Sequence
  Synthetic Construct
cagcctgcaattcctatggacta

SEQ ID NO: 33394 - DNA, 21 bp, Artificial Sequence
  Synthetic Construct
acctgtggctcttctccatct

SEQ ID NO: 33395 - DNA, 26 bp, Artificial Sequence
  Synthetic Construct
gagtctgatcataccagaccatcctt

SEQ ID NO: 33396 - DNA, 26 bp, Artificial Sequence
  Synthetic Construct
gagctcgtgataacaatatccctttg

SEQ ID NO: 33397 - DNA, 25 bp, Artificial Sequence
  Synthetic Construct
cacgctcaattttctcctgttttca

SEQ ID NO: 33398 - DNA, 26 bp, Artificial Sequence
  Synthetic Construct
ggaaagtgggaaacttgaaactgaga

SEQ ID NO: 33399 - DNA, 22 bp, Artificial Sequence
  Synthetic Construct
ccagcaggaccctgactgtact

SEQ ID NO: 33400 - DNA, 28 bp, Artificial Sequence
  Synthetic Construct
caggacctgacattaaccttggttttag

SEQ ID NO: 33401 - DNA, 23 bp, Artificial Sequence
  Synthetic Construct
gcatctatggggaatgggagcaa

SEQ ID NO: 33402 - DNA, 21 bp, Artificial Sequence
  Synthetic Construct
cagcaaggcgttttccactga

SEQ ID NO: 33403 - DNA, 22 bp, Artificial Sequence
  Synthetic Construct
gcctgcttggtatcccctgaat

SEQ ID NO: 33404 - DNA, 26 bp, Artificial Sequence
  Synthetic Construct
caggacacaattggaaacactggtta

SEQ ID NO: 33405 - DNA, 28 bp, Artificial Sequence
  Synthetic Construct
ctgccagctactaagtatgtctatgcta

SEQ ID NO: 33406 - DNA, 20 bp, Artificial Sequence
  Synthetic Construct
gcctaagagcaggcatgcaa

SEQ ID NO: 33407 - DNA, 22 bp, Artificial Sequence
  Synthetic Construct
ggcagctgtggtagacctttgt

SEQ ID NO: 33408 - DNA, 24 bp, Artificial Sequence
  Synthetic Construct
ccattagtggctccatacccttca

SEQ ID NO: 33409 - DNA, 26 bp, Artificial Sequence
  Synthetic Construct
cctgaagccatcaagtttcaggttta

SEQ ID NO: 33410 - DNA, 24 bp, Artificial Sequence
  Synthetic Construct
ctggggactggtcgtataggtatc

SEQ ID NO: 33411 - DNA, 20 bp, Artificial Sequence
  Synthetic Construct
ggccatggacctttggcaat

SEQ ID NO: 33412 - DNA, 26 bp, Artificial Sequence
  Synthetic Construct
gaatgtggatttagcttctccctaga

SEQ ID NO: 33413 - DNA, 27 bp, Artificial Sequence
  Synthetic Construct
caccatgagtttgactttgtacctgat

SEQ ID NO: 33414 - DNA, 20 bp, Artificial Sequence
  Synthetic Construct
ttcctgactccaccgtcctt

SEQ ID NO: 33415 - DNA, 30 bp, Artificial Sequence
  Synthetic Construct
ggagaaatctctgtttctcaccatgactct

SEQ ID NO: 33416 - DNA, 22 bp, Artificial Sequence
  Synthetic Construct
ttccctcaccctcagggatctt

SEQ ID NO: 33417 - DNA, 19 bp, Artificial Sequence
  Synthetic Construct
agggccagaggtgcgcaaa

SEQ ID NO: 33418 - DNA, 21 bp, Artificial Sequence
  Synthetic Construct
caagctgcccctactacaaca

SEQ ID NO: 33419 - DNA, 21 bp, Artificial Sequence
  Synthetic Construct
agccagtgggaggagcagata

SEQ ID NO: 33420 - DNA, 24 bp, Artificial Sequence
  Synthetic Construct
tgtcacggaaactatcacctttga

SEQ ID NO: 33421 - DNA, 25 bp, Artificial Sequence
  Synthetic Construct
gggactaaagcctgagagcatgaga

SEQ ID NO: 33422 - DNA, 24 bp, Artificial Sequence
  Synthetic Construct
gttgagccacctgcattttcttac

SEQ ID NO: 33423 - DNA, 21 bp, Artificial Sequence
  Synthetic Construct
aaccaggggaccaggatatgt

SEQ ID NO: 33424 - DNA, 21 bp, Artificial Sequence
  Synthetic Construct
gggtgaggtgtcctggtctgt

SEQ ID NO: 33425 - DNA, 24 bp, Artificial Sequence
  Synthetic Construct
ctcattccctctctcccacctaac

SEQ ID NO: 33426 - DNA, 20 bp, Artificial Sequence
  Synthetic Construct
gagccaagccatgacacact

SEQ ID NO: 33427 - DNA, 23 bp, Artificial Sequence
  Synthetic Construct
ggaggagcttccctgattggtat

SEQ ID NO: 33428 - DNA, 22 bp, Artificial Sequence
  Synthetic Construct
gcacatgaactgccacgtccta

SEQ ID NO: 33429 - DNA, 27 bp, Artificial Sequence
  Synthetic Construct
ggtggttgtagctgtgatttaacaaga

SEQ ID NO: 33430 - DNA, 26 bp, Artificial Sequence
  Synthetic Construct
tccttcttcagtcctgttgaaagtag

SEQ ID NO: 33431 - DNA, 22 bp, Artificial Sequence
  Synthetic Construct
atcctcaggggctccaggatct

SEQ ID NO: 33432 - DNA, 25 bp, Artificial Sequence
  Synthetic Construct
ggtggagaccagtaggttttattgt

SEQ ID NO: 33433 - DNA, 26 bp, Artificial Sequence
  Synthetic Construct
ccaggaaaatatcaggctcagtttca

SEQ ID NO: 33434 - DNA, 28 bp, Artificial Sequence
  Synthetic Construct
ggtgaaatgtaagctctctggttctttc

SEQ ID NO: 33435 - DNA, 25 bp, Artificial Sequence
  Synthetic Construct
gggtgctgaaatggttggaatgagt

SEQ ID NO: 33436 - DNA, 22 bp, Artificial Sequence
  Synthetic Construct
ggcccagcctataaaaccacat

SEQ ID NO: 33437 - DNA, 26 bp, Artificial Sequence
  Synthetic Construct
ggttaaaaacatgggccttagagtca

SEQ ID NO: 33438 - DNA, 21 bp, Artificial Sequence
  Synthetic Construct
cccacagctagggcaatctga

SEQ ID NO: 33439 - DNA, 23 bp, Artificial Sequence
  Synthetic Construct
gcagagggcactcataagtcagt

SEQ ID NO: 33440 - DNA, 23 bp, Artificial Sequence
  Synthetic Construct
gtccggggacacattctagtttc

SEQ ID NO: 33441 - DNA, 26 bp, Artificial Sequence
  Synthetic Construct
ctaaagacctaagcctgttcacatct

SEQ ID NO: 33442 - DNA, 22 bp, Artificial Sequence
  Synthetic Construct
gtgccaccttactggccaaaga

SEQ ID NO: 33443 - DNA, 21 bp, Artificial Sequence
  Synthetic Construct
ccagctgcagatgaagctcaa

SEQ ID NO: 33444 - DNA, 27 bp, Artificial Sequence
  Synthetic Construct
gtaagtcaagtcacaccaattccttac

SEQ ID NO: 33445 - DNA, 24 bp, Artificial Sequence
  Synthetic Construct
cagatcccagtgttctgaacttga

SEQ ID NO: 33446 - DNA, 22 bp, Artificial Sequence
  Synthetic Construct
gcctgtaccacctcctgctaat

SEQ ID NO: 33447 - DNA, 22 bp, Artificial Sequence
  Synthetic Construct
ctgaacatgcacccgagacaga

SEQ ID NO: 33448 - DNA, 18 bp, Artificial Sequence
  Synthetic Construct
agccaggcctcctgttct

SEQ ID NO: 33449 - DNA, 20 bp, Artificial Sequence
  Synthetic Construct
gcaagccccatcaaccatct

SEQ ID NO: 33450 - DNA, 24 bp, Artificial Sequence
  Synthetic Construct
gatgcctcaaaacgcctcatagat

SEQ ID NO: 33451 - DNA, 25 bp, Artificial Sequence
  Synthetic Construct
gagtcaatgaatactgcaccctctt

SEQ ID NO: 33452 - DNA, 24 bp, Artificial Sequence
  Synthetic Construct
cccagggaatctgctggaatgtag

SEQ ID NO: 33453 - DNA, 23 bp, Artificial Sequence
  Synthetic Construct
aaaatggaccctaactgccagaa

SEQ ID NO: 33454 - DNA, 22 bp, Artificial Sequence
  Synthetic Construct
ggatccctgcctctaactctga

SEQ ID NO: 33455 - DNA, 25 bp, Artificial Sequence
  Synthetic Construct
gttccagaaatctatgaggccatga

SEQ ID NO: 33456 - DNA, 24 bp, Artificial Sequence
  Synthetic Construct
gggaaggccagagagtaagctaca

SEQ ID NO: 33457 - DNA, 24 bp, Artificial Sequence
  Synthetic Construct
gattggaaggacataggcagttca

SEQ ID NO: 33458 - DNA, 24 bp, Artificial Sequence
  Synthetic Construct
gtcccttgacaaagttcccctaga

SEQ ID NO: 33459 - DNA, 22 bp, Artificial Sequence
  Synthetic Construct
gagagtctgggaaggctgaact

SEQ ID NO: 33460 - DNA, 26 bp, Artificial Sequence
  Synthetic Construct
cactattttccacactgagggcatct

SEQ ID NO: 33461 - DNA, 24 bp, Artificial Sequence
  Synthetic Construct
cgtagaaccaagcctgagatatga

SEQ ID NO: 33462 - DNA, 21 bp, Artificial Sequence
  Synthetic Construct
tcgaggagcccagcacatcta

SEQ ID NO: 33463 - DNA, 25 bp, Artificial Sequence
  Synthetic Construct
tgatgtctttggcagagtgttttac

SEQ ID NO: 33464 - DNA, 21 bp, Artificial Sequence
  Synthetic Construct
ctaggcctcagcatcaagcat

SEQ ID NO: 33465 - DNA, 26 bp, Artificial Sequence
  Synthetic Construct
cccttgtagcctatgtttatccttga

SEQ ID NO: 33466 - DNA, 24 bp, Artificial Sequence
  Synthetic Construct
cccaaactgggtctcctctttgat

SEQ ID NO: 33467 - DNA, 21 bp, Artificial Sequence
  Synthetic Construct
cccacctcccagacagcattt

SEQ ID NO: 33468 - DNA, 23 bp, Artificial Sequence
  Synthetic Construct
ttcacattactcgcaaggtcagt

SEQ ID NO: 33469 - DNA, 23 bp, Artificial Sequence
  Synthetic Construct
tgatgaccatgccacatctgtaa

SEQ ID NO: 33470 - DNA, 25 bp, Artificial Sequence
  Synthetic Construct
ggggaaaacagtgacaagtcacgaa

SEQ ID NO: 33471 - DNA, 22 bp, Artificial Sequence
  Synthetic Construct
gagtggtgccacttctgcttca

SEQ ID NO: 33472 - DNA, 25 bp, Artificial Sequence
  Synthetic Construct
gcacttgggagagggaaaaatgcaa

SEQ ID NO: 33473 - DNA, 25 bp, Artificial Sequence
  Synthetic Construct
ccctcatttgtaggtctaccctgat

SEQ ID NO: 33474 - DNA, 20 bp, Artificial Sequence
  Synthetic Construct
ccctgccatgttgccagata

SEQ ID NO: 33475 - DNA, 22 bp, Artificial Sequence
  Synthetic Construct
gggtcggactcttggcatcttc

SEQ ID NO: 33476 - DNA, 22 bp, Artificial Sequence
  Synthetic Construct
aggagctaccacggggtatgaa

SEQ ID NO: 33477 - DNA, 26 bp, Artificial Sequence
  Synthetic Construct
gctttccccttttcctgaaaaaccaa

SEQ ID NO: 33478 - DNA, 25 bp, Artificial Sequence
  Synthetic Construct
cagctgagatcattctgcccttcaa

SEQ ID NO: 33479 - DNA, 24 bp, Artificial Sequence
  Synthetic Construct
acaaatcctaacacagcacgtgaa

SEQ ID NO: 33480 - DNA, 23 bp, Artificial Sequence
  Synthetic Construct
ctgttttcgagcagctagggatt

SEQ ID NO: 33481 - DNA, 26 bp, Artificial Sequence
  Synthetic Construct
tggaatcctttcccctgtaagataac

SEQ ID NO: 33482 - DNA, 20 bp, Artificial Sequence
  Synthetic Construct
gccagaccacttcaggaaca

SEQ ID NO: 33483 - DNA, 26 bp, Artificial Sequence
  Synthetic Construct
ctgttagaaggtttcctctcatggtt

SEQ ID NO: 33484 - DNA, 24 bp, Artificial Sequence
  Synthetic Construct
ccagctgaatgcttggagatggtt

SEQ ID NO: 33485 - DNA, 23 bp, Artificial Sequence
  Synthetic Construct
cactgcagagaagtttgggcttt

SEQ ID NO: 33486 - DNA, 27 bp, Artificial Sequence
  Synthetic Construct
gtgagatgactcaccctttttgcttag

SEQ ID NO: 33487 - DNA, 22 bp, Artificial Sequence
  Synthetic Construct
ctgtggggcagtcagtttttct

SEQ ID NO: 33488 - DNA, 25 bp, Artificial Sequence
  Synthetic Construct
acctaaccctatctcagctgttttc

SEQ ID NO: 33489 - DNA, 27 bp, Artificial Sequence
  Synthetic Construct
cagatacagagatcaattccagctagt

SEQ ID NO: 33490 - DNA, 28 bp, Artificial Sequence
  Synthetic Construct
gcgtctcagatgggttttatgtaactct

SEQ ID NO: 33491 - DNA, 22 bp, Artificial Sequence
  Synthetic Construct
gctcctctctgaagttgggttt

SEQ ID NO: 33492 - DNA, 21 bp, Artificial Sequence
  Synthetic Construct
ggcctgaggcaggtttgagtt

SEQ ID NO: 33493 - DNA, 20 bp, Artificial Sequence
  Synthetic Construct
tacccaggaagccgcctgaa

SEQ ID NO: 33494 - DNA, 20 bp, Artificial Sequence
  Synthetic Construct
aggctgcctaggggctattt

SEQ ID NO: 33495 - DNA, 22 bp, Artificial Sequence
  Synthetic Construct
tggggaggagggactctagttt

SEQ ID NO: 33496 - DNA, 22 bp, Artificial Sequence
  Synthetic Construct
aggtgccagagactgcagaaac

SEQ ID NO: 33497 - DNA, 20 bp, Artificial Sequence
  Synthetic Construct
ccactgcacctggcctatca

SEQ ID NO: 33498 - DNA, 25 bp, Artificial Sequence
  Synthetic Construct
tccttgtcatgttccttcctctttt

SEQ ID NO: 33499 - DNA, 27 bp, Artificial Sequence
  Synthetic Construct
cagatatccatgggaatcaacagtttc

SEQ ID NO: 33500 - DNA, 24 bp, Artificial Sequence
  Synthetic Construct
tgtgctttcacttcctggaaactt

SEQ ID NO: 33501 - DNA, 24 bp, Artificial Sequence
  Synthetic Construct
gccccagttcaaaatctcttgtca

SEQ ID NO: 33502 - DNA, 27 bp, Artificial Sequence
  Synthetic Construct
ggaagaccaaaaagggataaaggttga

SEQ ID NO: 33503 - DNA, 23 bp, Artificial Sequence
  Synthetic Construct
gcctagaggggtggaaagcaaag

SEQ ID NO: 33504 - DNA, 20 bp, Artificial Sequence
  Synthetic Construct
tgcgtctgcatgggtggttt

SEQ ID NO: 33505 - DNA, 22 bp, Artificial Sequence
  Synthetic Construct
gacagccctgtgacgtaggaat

SEQ ID NO: 33506 - DNA, 27 bp, Artificial Sequence
  Synthetic Construct
gagaaacagtagggtcaaaggaacaga

SEQ ID NO: 33507 - DNA, 27 bp, Artificial Sequence
  Synthetic Construct
ggagcaaatttggtggattaaggatag

SEQ ID NO: 33508 - DNA, 21 bp, Artificial Sequence
  Synthetic Construct
cgctcctgccgcaaaactcta

SEQ ID NO: 33509 - DNA, 19 bp, Artificial Sequence
  Synthetic Construct
tgcctccaccttgctgcta

SEQ ID NO: 33510 - DNA, 24 bp, Artificial Sequence
  Synthetic Construct
gagcaaagaggttaaggtcacagt

SEQ ID NO: 33511 - DNA, 21 bp, Artificial Sequence
  Synthetic Construct
ggcacctgcagaccagttctt

SEQ ID NO: 33512 - DNA, 23 bp, Artificial Sequence
  Synthetic Construct
cgatccccttggtgtgagagttg

SEQ ID NO: 33513 - DNA, 24 bp, Artificial Sequence
  Synthetic Construct
cctaggatagcccactggatgtag

SEQ ID NO: 33514 - DNA, 23 bp, Artificial Sequence
  Synthetic Construct
ccctccaaggacgtcttccctaa

SEQ ID NO: 33515 - DNA, 22 bp, Artificial Sequence
  Synthetic Construct
ctttgtgtctcaggctcaccat

SEQ ID NO: 33516 - DNA, 24 bp, Artificial Sequence
  Synthetic Construct
agtcccgcctcctctatagtcatc

SEQ ID NO: 33517 - DNA, 23 bp, Artificial Sequence
  Synthetic Construct
gccagggatagctaacaatgaca

SEQ ID NO: 33518 - DNA, 27 bp, Artificial Sequence
  Synthetic Construct
gtggactcctctaggtcaagctatttg

SEQ ID NO: 33519 - DNA, 27 bp, Artificial Sequence
  Synthetic Construct
acatcatgtggatagaatggggattag

SEQ ID NO: 33520 - DNA, 22 bp, Artificial Sequence
  Synthetic Construct
ccagcctgaggttccttcagat

SEQ ID NO: 33521 - DNA, 24 bp, Artificial Sequence
  Synthetic Construct
gcgagctatcttgcaggctagtaa

SEQ ID NO: 33522 - DNA, 25 bp, Artificial Sequence
  Synthetic Construct
aagtaatgcaggatgagtgatggat

SEQ ID NO: 33523 - DNA, 21 bp, Artificial Sequence
  Synthetic Construct
ggggtggctcagaaacccttt

SEQ ID NO: 33524 - DNA, 27 bp, Artificial Sequence
  Synthetic Construct
ctctactgagagacaagcaaagtttca

SEQ ID NO: 33525 - DNA, 23 bp, Artificial Sequence
  Synthetic Construct
cgccctacttcacttgtttcttg

SEQ ID NO: 33526 - DNA, 23 bp, Artificial Sequence
  Synthetic Construct
gggaggctatccaaccagtaagt

SEQ ID NO: 33527 - DNA, 20 bp, Artificial Sequence
  Synthetic Construct
cccacccctgcccatcttac

SEQ ID NO: 33528 - DNA, 20 bp, Artificial Sequence
  Synthetic Construct
tgggctcccacacctgtttc

SEQ ID NO: 33529 - DNA, 23 bp, Artificial Sequence
  Synthetic Construct
ggctgtgaagaagcagtgaggat

SEQ ID NO: 33530 - DNA, 25 bp, Artificial Sequence
  Synthetic Construct
cctcaatgaatagttcccacctcaa

SEQ ID NO: 33531 - DNA, 27 bp, Artificial Sequence
  Synthetic Construct
ctttaaactgggatcgctacagaaaag

SEQ ID NO: 33532 - DNA, 20 bp, Artificial Sequence
  Synthetic Construct
tgcccaggcagagggagcaa

SEQ ID NO: 33533 - DNA, 27 bp, Artificial Sequence
  Synthetic Construct
cccaaagtgccttgttttctctgatac

SEQ ID NO: 33534 - DNA, 22 bp, Artificial Sequence
  Synthetic Construct
ggctgcagcagagtgaataaga

SEQ ID NO: 33535 - DNA, 25 bp, Artificial Sequence
  Synthetic Construct
cactctgacagtgaggttcttggta

SEQ ID NO: 33536 - DNA, 21 bp, Artificial Sequence
  Synthetic Construct
gccatctcctgctgggttact

SEQ ID NO: 33537 - DNA, 25 bp, Artificial Sequence
  Synthetic Construct
tgcatacagcatactctgttcacat

SEQ ID NO: 33538 - DNA, 20 bp, Artificial Sequence
  Synthetic Construct
tcctacaggcccctgaactt

SEQ ID NO: 33539 - DNA, 25 bp, Artificial Sequence
  Synthetic Construct
ccgaaaagaggtaggcagagctaat

SEQ ID NO: 33540 - DNA, 24 bp, Artificial Sequence
  Synthetic Construct
gtgattggggcacagaactctcta

SEQ ID NO: 33541 - DNA, 24 bp, Artificial Sequence
  Synthetic Construct
ctgaaggtaggtcagatcaagcaa

SEQ ID NO: 33542 - DNA, 20 bp, Artificial Sequence
  Synthetic Construct
attccagccagccaccaatg

SEQ ID NO: 33543 - DNA, 24 bp, Artificial Sequence
  Synthetic Construct
actgtcatgtgtctctctgctttt

SEQ ID NO: 33544 - DNA, 22 bp, Artificial Sequence
  Synthetic Construct
gccttgcaccactacacagaga

SEQ ID NO: 33545 - DNA, 29 bp, Artificial Sequence
  Synthetic Construct
ggggagtattacaaagacctaaggaggta

SEQ ID NO: 33546 - DNA, 23 bp, Artificial Sequence
  Synthetic Construct
gcaatgtgtaccggttctgtact

SEQ ID NO: 33547 - DNA, 25 bp, Artificial Sequence
  Synthetic Construct
gggtctgttcatcactcaatcattc

SEQ ID NO: 33548 - DNA, 24 bp, Artificial Sequence
  Synthetic Construct
gacactgcctagcctttgtcattg

SEQ ID NO: 33549 - DNA, 20 bp, Artificial Sequence
  Synthetic Construct
tgctgggctgtggattggta

SEQ ID NO: 33550 - DNA, 22 bp, Artificial Sequence
  Synthetic Construct
agccaagaggagttgggacttg

SEQ ID NO: 33551 - DNA, 22 bp, Artificial Sequence
  Synthetic Construct
gcactcacagaagggcaggtaa

SEQ ID NO: 33552 - DNA, 24 bp, Artificial Sequence
  Synthetic Construct
gctggtggggagaggagtatagat

SEQ ID NO: 33553 - DNA, 22 bp, Artificial Sequence
  Synthetic Construct
gacccactgggaaggtatggta

SEQ ID NO: 33554 - DNA, 24 bp, Artificial Sequence
  Synthetic Construct
tcctatggggtcccatcattttct

SEQ ID NO: 33555 - DNA, 26 bp, Artificial Sequence
  Synthetic Construct
cattaaactcagtgctgtcctgttag

SEQ ID NO: 33556 - DNA, 26 bp, Artificial Sequence
  Synthetic Construct
gtgtctgatattcctgctcacttttg

SEQ ID NO: 33557 - DNA, 24 bp, Artificial Sequence
  Synthetic Construct
cattcccaacagcatgcctagata

SEQ ID NO: 33558 - DNA, 24 bp, Artificial Sequence
  Synthetic Construct
ggttagcttcagttcttgggagta

SEQ ID NO: 33559 - DNA, 22 bp, Artificial Sequence
  Synthetic Construct
gcatctcagcctttgggttttg

SEQ ID NO: 33560 - DNA, 23 bp, Artificial Sequence
  Synthetic Construct
cctagccctatggcagagttttc

SEQ ID NO: 33561 - DNA, 24 bp, Artificial Sequence
  Synthetic Construct
aactgttgccctatcctccattac

SEQ ID NO: 33562 - DNA, 26 bp, Artificial Sequence
  Synthetic Construct
ctggttgtcttcatgggatttcctta

SEQ ID NO: 33563 - DNA, 20 bp, Artificial Sequence
  Synthetic Construct
cagccctggaggagttctga

SEQ ID NO: 33564 - DNA, 20 bp, Artificial Sequence
  Synthetic Construct
ccagggtgctggagacattt

SEQ ID NO: 33565 - DNA, 27 bp, Artificial Sequence
  Synthetic Construct
ccagaggatatcccacagttcatctca

SEQ ID NO: 33566 - DNA, 27 bp, Artificial Sequence
  Synthetic Construct
ccacatcaacactattatccccaattc

SEQ ID NO: 33567 - DNA, 25 bp, Artificial Sequence
  Synthetic Construct
cggcctgaaatttctttacaaccat

SEQ ID NO: 33568 - DNA, 22 bp, Artificial Sequence
  Synthetic Construct
cagcctggtggacaccttgatt

SEQ ID NO: 33569 - DNA, 22 bp, Artificial Sequence
  Synthetic Construct
gtccgagctgttctgccttttg

SEQ ID NO: 33570 - DNA, 26 bp, Artificial Sequence
  Synthetic Construct
ggagcctcctacatacatcattccaa

SEQ ID NO: 33571 - DNA, 27 bp, Artificial Sequence
  Synthetic Construct
ccaggagtaaaatcagggaatctgagt

SEQ ID NO: 33572 - DNA, 23 bp, Artificial Sequence
  Synthetic Construct
acacactgtgacatgatgggatt

SEQ ID NO: 33573 - DNA, 24 bp, Artificial Sequence
  Synthetic Construct
tccactctgactcagtcttcagta

SEQ ID NO: 33574 - DNA, 23 bp, Artificial Sequence
  Synthetic Construct
agtgacctttggggttcttcttg

SEQ ID NO: 33575 - DNA, 23 bp, Artificial Sequence
  Synthetic Construct
ctgtctctggatcctgtgagtct

SEQ ID NO: 33576 - DNA, 23 bp, Artificial Sequence
  Synthetic Construct
gcccagacagcaagaaaggaagt

SEQ ID NO: 33577 - DNA, 20 bp, Artificial Sequence
  Synthetic Construct
gaacccgctggcattctctt

SEQ ID NO: 33578 - DNA, 19 bp, Artificial Sequence
  Synthetic Construct
acaggaagggcgggagtag

SEQ ID NO: 33579 - DNA, 24 bp, Artificial Sequence
  Synthetic Construct
gacctattgaggcttgggcaaagt

SEQ ID NO: 33580 - DNA, 22 bp, Artificial Sequence
  Synthetic Construct
acctacctgtggcctggaagat

SEQ ID NO: 33581 - DNA, 21 bp, Artificial Sequence
  Synthetic Construct
gacagagctgcagccagtaat

SEQ ID NO: 33582 - DNA, 21 bp, Artificial Sequence
  Synthetic Construct
aggcagagccagggcctaaat

SEQ ID NO: 33583 - DNA, 22 bp, Artificial Sequence
  Synthetic Construct
gagcatggcatggacctggaat

SEQ ID NO: 33584 - DNA, 18 bp, Artificial Sequence
  Synthetic Construct
agcgccacatggctgatg

SEQ ID NO: 33585 - DNA, 24 bp, Artificial Sequence
  Synthetic Construct
gcaaagcttgatggtggaagaaag

SEQ ID NO: 33586 - DNA, 24 bp, Artificial Sequence
  Synthetic Construct
gggaagcaaggagagcagctagta

SEQ ID NO: 33587 - DNA, 20 bp, Artificial Sequence
  Synthetic Construct
ggctcaggggcaaaagttgt

SEQ ID NO: 33588 - DNA, 24 bp, Artificial Sequence
  Synthetic Construct
gtcaccaggaaatgcacatctttt

SEQ ID NO: 33589 - DNA, 26 bp, Artificial Sequence
  Synthetic Construct
gccctgaaaattcgtgctatcaaatg

SEQ ID NO: 33590 - DNA, 25 bp, Artificial Sequence
  Synthetic Construct
tgacaggggctctagaagtagtaag

SEQ ID NO: 33591 - DNA, 23 bp, Artificial Sequence
  Synthetic Construct
ggccaacttcctgctaaggattg

SEQ ID NO: 33592 - DNA, 24 bp, Artificial Sequence
  Synthetic Construct
gctaggcattttgccagaggcttt

SEQ ID NO: 33593 - DNA, 22 bp, Artificial Sequence
  Synthetic Construct
agaacccgagaggcctatccaa

SEQ ID NO: 33594 - DNA, 22 bp, Artificial Sequence
  Synthetic Construct
gctttcctgctctggtgctgaa

SEQ ID NO: 33595 - DNA, 23 bp, Artificial Sequence
  Synthetic Construct
aactgatctggcctgctaaaact

SEQ ID NO: 33596 - DNA, 23 bp, Artificial Sequence
  Synthetic Construct
tgtgcttaacctcctagcctcat

SEQ ID NO: 33597 - DNA, 26 bp, Artificial Sequence
  Synthetic Construct
ggtgatattagtgaagccctctgttg

SEQ ID NO: 33598 - DNA, 27 bp, Artificial Sequence
  Synthetic Construct
ccaaagtagcaaaaggtgtctgcattc

SEQ ID NO: 33599 - DNA, 25 bp, Artificial Sequence
  Synthetic Construct
ggatgatgctggctaatgggagaaa

SEQ ID NO: 33600 - DNA, 21 bp, Artificial Sequence
  Synthetic Construct
accttgtctcccactccagat

SEQ ID NO: 33601 - DNA, 23 bp, Artificial Sequence
  Synthetic Construct
cacatgcatagcttagccagtga

SEQ ID NO: 33602 - DNA, 22 bp, Artificial Sequence
  Synthetic Construct
cgagagattggcagtcccagtt

SEQ ID NO: 33603 - DNA, 22 bp, Artificial Sequence
  Synthetic Construct
ccccattcaaagggctctcagt

SEQ ID NO: 33604 - DNA, 22 bp, Artificial Sequence
  Synthetic Construct
agcctgagtaaccagggactct

SEQ ID NO: 33605 - DNA, 22 bp, Artificial Sequence
  Synthetic Construct
cacagcctgctgctaattgttc

SEQ ID NO: 33606 - DNA, 24 bp, Artificial Sequence
  Synthetic Construct
gctgcaggagtgaaactaggaaca

SEQ ID NO: 33607 - DNA, 25 bp, Artificial Sequence
  Synthetic Construct
tcttccagaattcccttcaaagcat

SEQ ID NO: 33608 - DNA, 23 bp, Artificial Sequence
  Synthetic Construct
gtgaaagcaggtggtcatactct

SEQ ID NO: 33609 - DNA, 25 bp, Artificial Sequence
  Synthetic Construct
ctgcaggtagcagaattaactgaca

SEQ ID NO: 33610 - DNA, 23 bp, Artificial Sequence
  Synthetic Construct
ctgtgctcagatctgcattggat

SEQ ID NO: 33611 - DNA, 23 bp, Artificial Sequence
  Synthetic Construct
cactcatttgacttcccgctgtt

SEQ ID NO: 33612 - DNA, 26 bp, Artificial Sequence
  Synthetic Construct
acagggatccactggtatgataaaga

SEQ ID NO: 33613 - DNA, 23 bp, Artificial Sequence
  Synthetic Construct
ctgagcaggctattccagtctgt

SEQ ID NO: 33614 - DNA, 20 bp, Artificial Sequence
  Synthetic Construct
tcgccaaggacctaggaaca

SEQ ID NO: 33615 - DNA, 18 bp, Artificial Sequence
  Synthetic Construct
cggtggtgcgcaagtagt

SEQ ID NO: 33616 - DNA, 23 bp, Artificial Sequence
  Synthetic Construct
gagttgtgcagatgggttgaaaa

SEQ ID NO: 33617 - DNA, 22 bp, Artificial Sequence
  Synthetic Construct
cctggcatcacagtggctacaa

SEQ ID NO: 33618 - DNA, 18 bp, Artificial Sequence
  Synthetic Construct
agtgccccaccggtgttt

SEQ ID NO: 33619 - DNA, 27 bp, Artificial Sequence
  Synthetic Construct
ccttatagtgggttctgggacttagta

SEQ ID NO: 33620 - DNA, 20 bp, Artificial Sequence
  Synthetic Construct
gggtagccctgggaatgctt

SEQ ID NO: 33621 - DNA, 23 bp, Artificial Sequence
  Synthetic Construct
gaacctcgcctcattgtgatttc

SEQ ID NO: 33622 - DNA, 19 bp, Artificial Sequence
  Synthetic Construct
agcaccggcaggcgacttt

SEQ ID NO: 33623 - DNA, 27 bp, Artificial Sequence
  Synthetic Construct
ctccagaattctacggaaactggaagt

SEQ ID NO: 33624 - DNA, 23 bp, Artificial Sequence
  Synthetic Construct
gctctgtactggccactttgttc

SEQ ID NO: 33625 - DNA, 23 bp, Artificial Sequence
  Synthetic Construct
ccagcctagacctaaacccttga

SEQ ID NO: 33626 - DNA, 22 bp, Artificial Sequence
  Synthetic Construct
gtgatgccagacagagctgaca

SEQ ID NO: 33627 - DNA, 24 bp, Artificial Sequence
  Synthetic Construct
gcttaagccacagaaaggcacaac

SEQ ID NO: 33628 - DNA, 21 bp, Artificial Sequence
  Synthetic Construct
cgagtgccctggaacctgaaa

SEQ ID NO: 33629 - DNA, 21 bp, Artificial Sequence
  Synthetic Construct
agccaccactcctgcttctga

SEQ ID NO: 33630 - DNA, 20 bp, Artificial Sequence
  Synthetic Construct
ttggggacccctggactaag

SEQ ID NO: 33631 - DNA, 26 bp, Artificial Sequence
  Synthetic Construct
cctccccagtatcttaccactacaac

SEQ ID NO: 33632 - DNA, 22 bp, Artificial Sequence
  Synthetic Construct
caccaagccctcaactcctaaa

SEQ ID NO: 33633 - DNA, 25 bp, Artificial Sequence
  Synthetic Construct
gaagtgaaagaaaatggcaggaact

SEQ ID NO: 33634 - DNA, 27 bp, Artificial Sequence
  Synthetic Construct
gctggtattgttttggggatagaggtt

SEQ ID NO: 33635 - DNA, 26 bp, Artificial Sequence
  Synthetic Construct
gtggaggaaattagatgtctgcttct

SEQ ID NO: 33636 - DNA, 21 bp, Artificial Sequence
  Synthetic Construct
gggcaagtccctcacaccttt

SEQ ID NO: 33637 - DNA, 21 bp, Artificial Sequence
  Synthetic Construct
tgaggtctggctgcaggagta

SEQ ID NO: 33638 - DNA, 22 bp, Artificial Sequence
  Synthetic Construct
ctgaagcccaagtggcaagaag

SEQ ID NO: 33639 - DNA, 22 bp, Artificial Sequence
  Synthetic Construct
aagtcctgagcctgagttcttg

SEQ ID NO: 33640 - DNA, 21 bp, Artificial Sequence
  Synthetic Construct
tctcagggtgcctggaaaaag

SEQ ID NO: 33641 - DNA, 24 bp, Artificial Sequence
  Synthetic Construct
gcactgcaaaagaagaggctattg

SEQ ID NO: 33642 - DNA, 20 bp, Artificial Sequence
  Synthetic Construct
tgggaaccagccctttggaa

SEQ ID NO: 33643 - DNA, 29 bp, Artificial Sequence
  Synthetic Construct
ggcttcactatcaagaagggccttgattt

SEQ ID NO: 33644 - DNA, 18 bp, Artificial Sequence
  Synthetic Construct
aagaggccacccgcttct

SEQ ID NO: 33645 - DNA, 19 bp, Artificial Sequence
  Synthetic Construct
tggagcaggctggcgctaa

SEQ ID NO: 33646 - DNA, 21 bp, Artificial Sequence
  Synthetic Construct
ccgaaaaccttccccgcttct

SEQ ID NO: 33647 - DNA, 24 bp, Artificial Sequence
  Synthetic Construct
ggaaggggaatttgtcagcgttta

SEQ ID NO: 33648 - DNA, 24 bp, Artificial Sequence
  Synthetic Construct
gcagtctcagcctttcctttgcat

SEQ ID NO: 33649 - DNA, 24 bp, Artificial Sequence
  Synthetic Construct
gttgggaagcatcttcctagacat

SEQ ID NO: 33650 - DNA, 24 bp, Artificial Sequence
  Synthetic Construct
gcctattttggagtcccaagtcaa

SEQ ID NO: 33651 - DNA, 18 bp, Artificial Sequence
  Synthetic Construct
tgggccacgttgcctact

SEQ ID NO: 33652 - DNA, 29 bp, Artificial Sequence
  Synthetic Construct
caccttattactaccttcctctcacaatg

SEQ ID NO: 33653 - DNA, 21 bp, Artificial Sequence
  Synthetic Construct
actggggtaaaggctggttgt

SEQ ID NO: 33654 - DNA, 21 bp, Artificial Sequence
  Synthetic Construct
aagcctcgtggccgactcaat

SEQ ID NO: 33655 - DNA, 21 bp, Artificial Sequence
  Synthetic Construct
aacagggcgtgagttttcctt

SEQ ID NO: 33656 - DNA, 23 bp, Artificial Sequence
  Synthetic Construct
ggagaggccagggcatttctaag

SEQ ID NO: 33657 - DNA, 23 bp, Artificial Sequence
  Synthetic Construct
cagcctgctaggaacacactgta

SEQ ID NO: 33658 - DNA, 23 bp, Artificial Sequence
  Synthetic Construct
ggtgattctggccgaacttgtct

SEQ ID NO: 33659 - DNA, 22 bp, Artificial Sequence
  Synthetic Construct
tggatcggaaacaccagactca

SEQ ID NO: 33660 - DNA, 26 bp, Artificial Sequence
  Synthetic Construct
cctgagaccgttgctagagaaacaag

SEQ ID NO: 33661 - DNA, 19 bp, Artificial Sequence
  Synthetic Construct
tgggatgcgggcatagaga

SEQ ID NO: 33662 - DNA, 20 bp, Artificial Sequence
  Synthetic Construct
tctcccaggcttcagtcctt

SEQ ID NO: 33663 - DNA, 23 bp, Artificial Sequence
  Synthetic Construct
ccaagttatgcctgctgctcaga

SEQ ID NO: 33664 - DNA, 24 bp, Artificial Sequence
  Synthetic Construct
gggaacctggaaagacctttactt

SEQ ID NO: 33665 - DNA, 25 bp, Artificial Sequence
  Synthetic Construct
ggtgggatagttgagaagggagtaa

SEQ ID NO: 33666 - DNA, 20 bp, Artificial Sequence
  Synthetic Construct
cctcagctcccgcctctaaa

SEQ ID NO: 33667 - DNA, 23 bp, Artificial Sequence
  Synthetic Construct
ggatgagcataagcagtggttca

SEQ ID NO: 33668 - DNA, 24 bp, Artificial Sequence
  Synthetic Construct
aggagtgagaagggagactcaatc

SEQ ID NO: 33669 - DNA, 19 bp, Artificial Sequence
  Synthetic Construct
tcaagtcccggctgccatt

SEQ ID NO: 33670 - DNA, 22 bp, Artificial Sequence
  Synthetic Construct
gacagagagatgagggctgagt

SEQ ID NO: 33671 - DNA, 24 bp, Artificial Sequence
  Synthetic Construct
aattgccagctgtattctccttct

SEQ ID NO: 33672 - DNA, 20 bp, Artificial Sequence
  Synthetic Construct
acagaggatggggcaccaaa

SEQ ID NO: 33673 - DNA, 25 bp, Artificial Sequence
  Synthetic Construct
gcatgaggatggaatggactcatca

SEQ ID NO: 33674 - DNA, 23 bp, Artificial Sequence
  Synthetic Construct
gaccttcaaggggagctcagtat

SEQ ID NO: 33675 - DNA, 24 bp, Artificial Sequence
  Synthetic Construct
tctgatatggaacccagggattgt

SEQ ID NO: 33676 - DNA, 20 bp, Artificial Sequence
  Synthetic Construct
tgcaccatcgctaggccatt

SEQ ID NO: 33677 - DNA, 24 bp, Artificial Sequence
  Synthetic Construct
gtcagttcacacgacacccttaga

SEQ ID NO: 33678 - DNA, 20 bp, Artificial Sequence
  Synthetic Construct
agcctggaaagctggcacaa

SEQ ID NO: 33679 - DNA, 21 bp, Artificial Sequence
  Synthetic Construct
ttcccagcctcctctgcatct

SEQ ID NO: 33680 - DNA, 22 bp, Artificial Sequence
  Synthetic Construct
ctcaaaggggaagaacgtcagt

SEQ ID NO: 33681 - DNA, 21 bp, Artificial Sequence
  Synthetic Construct
tctgcgtctcacttcctggta

SEQ ID NO: 33682 - DNA, 23 bp, Artificial Sequence
  Synthetic Construct
aaggtgacagaggtcttccaaag

SEQ ID NO: 33683 - DNA, 21 bp, Artificial Sequence
  Synthetic Construct
tcccaaatcctgagcctgtca

SEQ ID NO: 33684 - DNA, 22 bp, Artificial Sequence
  Synthetic Construct
ggagaaagagtggagagcaaca

SEQ ID NO: 33685 - DNA, 29 bp, Artificial Sequence
  Synthetic Construct
gactatacgataccaaatagccctacaag

SEQ ID NO: 33686 - DNA, 20 bp, Artificial Sequence
  Synthetic Construct
gtcacaagggaggcacttca

SEQ ID NO: 33687 - DNA, 20 bp, Artificial Sequence
  Synthetic Construct
agagctgccctggaactgaa

SEQ ID NO: 33688 - DNA, 24 bp, Artificial Sequence
  Synthetic Construct
ggaaaggtaccccagaatgaggtt

SEQ ID NO: 33689 - DNA, 23 bp, Artificial Sequence
  Synthetic Construct
ggtggtagaggctcatgtctctt

SEQ ID NO: 33690 - DNA, 22 bp, Artificial Sequence
  Synthetic Construct
tccccaaatcctttggcaatgt

SEQ ID NO: 33691 - DNA, 22 bp, Artificial Sequence
  Synthetic Construct
gtgtcaaagggcctgttcttgt

SEQ ID NO: 33692 - DNA, 24 bp, Artificial Sequence
  Synthetic Construct
ctctcatcagctgtttgctgttac

SEQ ID NO: 33693 - DNA, 25 bp, Artificial Sequence
  Synthetic Construct
gacctctttctccctgcacatgtaa

SEQ ID NO: 33694 - DNA, 24 bp, Artificial Sequence
  Synthetic Construct
ccttccttgaacttgcctctggta

SEQ ID NO: 33695 - DNA, 23 bp, Artificial Sequence
  Synthetic Construct
gctgtcaccaagactgagactga

SEQ ID NO: 33696 - DNA, 24 bp, Artificial Sequence
  Synthetic Construct
tgaaagctattgggacaacaggat

SEQ ID NO: 33697 - DNA, 27 bp, Artificial Sequence
  Synthetic Construct
caggaagataagtactgagccatgtgt

SEQ ID NO: 33698 - DNA, 23 bp, Artificial Sequence
  Synthetic Construct
gcacatgtctgcgacctcacttt

SEQ ID NO: 33699 - DNA, 22 bp, Artificial Sequence
  Synthetic Construct
cagcagagcagagtgctattgt

SEQ ID NO: 33700 - DNA, 21 bp, Artificial Sequence
  Synthetic Construct
gctgttgcactgtgaacttgt

SEQ ID NO: 33701 - DNA, 22 bp, Artificial Sequence
  Synthetic Construct
gcagcagacagctggagatgaa

SEQ ID NO: 33702 - DNA, 23 bp, Artificial Sequence
  Synthetic Construct
ctctgctgttccctcacctgtaa

SEQ ID NO: 33703 - DNA, 20 bp, Artificial Sequence
  Synthetic Construct
tctggcttctcagtgcgttt

SEQ ID NO: 33704 - DNA, 27 bp, Artificial Sequence
  Synthetic Construct
tgtcaagggactaagtttctaggtttc

SEQ ID NO: 33705 - DNA, 24 bp, Artificial Sequence
  Synthetic Construct
ggctcatgcttgtgataggagaca

SEQ ID NO: 33706 - DNA, 25 bp, Artificial Sequence
  Synthetic Construct
gccgaggagaatatgggttggaaac

SEQ ID NO: 33707 - DNA, 24 bp, Artificial Sequence
  Synthetic Construct
gcatcttgtggttgcccttagcaa

SEQ ID NO: 33708 - DNA, 19 bp, Artificial Sequence
  Synthetic Construct
gtccattgggcagccttct

SEQ ID NO: 33709 - DNA, 22 bp, Artificial Sequence
  Synthetic Construct
cctgatgctccctctgccaaaa

SEQ ID NO: 33710 - DNA, 25 bp, Artificial Sequence
  Synthetic Construct
gcctcattctcgcacacatccaatc

SEQ ID NO: 33711 - DNA, 22 bp, Artificial Sequence
  Synthetic Construct
gcccttcctcttgctgaacagt

SEQ ID NO: 33712 - DNA, 20 bp, Artificial Sequence
  Synthetic Construct
acctgaagccaggcactttc

SEQ ID NO: 33713 - DNA, 20 bp, Artificial Sequence
  Synthetic Construct
tgggagaaaaagcccacgtt

SEQ ID NO: 33714 - DNA, 23 bp, Artificial Sequence
  Synthetic Construct
gcaaggctcagtagggtgaaaag

SEQ ID NO: 33715 - DNA, 24 bp, Artificial Sequence
  Synthetic Construct
gccaaactgcttcttgctggatct

SEQ ID NO: 33716 - DNA, 23 bp, Artificial Sequence
  Synthetic Construct
ggaaaggcggtggtaatgtggtt

SEQ ID NO: 33717 - DNA, 21 bp, Artificial Sequence
  Synthetic Construct
tctgaccaagtccgcctctca

SEQ ID NO: 33718 - DNA, 24 bp, Artificial Sequence
  Synthetic Construct
cctcacactttcctgtccttgact

SEQ ID NO: 33719 - DNA, 26 bp, Artificial Sequence
  Synthetic Construct
cagctgatctatgcattggaggacat

SEQ ID NO: 33720 - DNA, 26 bp, Artificial Sequence
  Synthetic Construct
gcatctacccaatcactacagttaga

SEQ ID NO: 33721 - DNA, 21 bp, Artificial Sequence
  Synthetic Construct
ctcatcagacacaggcagctt

SEQ ID NO: 33722 - DNA, 23 bp, Artificial Sequence
  Synthetic Construct
agggcaaaagctttccagagtag

SEQ ID NO: 33723 - DNA, 24 bp, Artificial Sequence
  Synthetic Construct
gcaaagtttcatggccaagtgtca

SEQ ID NO: 33724 - DNA, 20 bp, Artificial Sequence
  Synthetic Construct
tgctgccaggctgctgaaat

SEQ ID NO: 33725 - DNA, 20 bp, Artificial Sequence
  Synthetic Construct
tccccaggcacctgctccaa

SEQ ID NO: 33726 - DNA, 27 bp, Artificial Sequence
  Synthetic Construct
tcacctacctaggattaaaggtgaaag

SEQ ID NO: 33727 - DNA, 20 bp, Artificial Sequence
  Synthetic Construct
ggacaggttggtgccagatt

SEQ ID NO: 33728 - DNA, 19 bp, Artificial Sequence
  Synthetic Construct
aaggaggtcctggggcaat

SEQ ID NO: 33729 - DNA, 22 bp, Artificial Sequence
  Synthetic Construct
cttgcctaggaagggcattaca

SEQ ID NO: 33730 - DNA, 20 bp, Artificial Sequence
  Synthetic Construct
gttgcagcctggaggagaaa

SEQ ID NO: 33731 - DNA, 30 bp, Artificial Sequence; identical to SEQ ID NO: 2505
  Synthetic Construct

SEQ ID NO: 33732 - DNA, 19 bp, Artificial Sequence
  Synthetic Construct
tgggtgagggcggatcttc

SEQ ID NO: 33733 - DNA, 24 bp, Artificial Sequence
  Synthetic Construct
cccagagaggctggatactgtgta

SEQ ID NO: 33734 - DNA, 26 bp, Artificial Sequence
  Synthetic Construct
cctgtggctcctgagagagaaatcaa

SEQ ID NO: 33735 - DNA, 20 bp, Artificial Sequence
  Synthetic Construct
tgggacacttcaggccaaga

SEQ ID NO: 33736 - DNA, 22 bp, Artificial Sequence
  Synthetic Construct
ggctagcattcggcgaaaatga

SEQ ID NO: 33737 - DNA, 28 bp, Artificial Sequence
  Synthetic Construct
gctcagatgtgtaaaggaaggcagtaca

SEQ ID NO: 33738 - DNA, 20 bp, Artificial Sequence
  Synthetic Construct
ttcccggtgttctggcgatt

SEQ ID NO: 33739 - DNA, 26 bp, Artificial Sequence
  Synthetic Construct
ggcatgtaagggtgacaaaggagttg

SEQ ID NO: 33740 - DNA, 20 bp, Artificial Sequence
  Synthetic Construct
ccctcccaggcttctcatct

SEQ ID NO: 33741 - DNA, 22 bp, Artificial Sequence
  Synthetic Construct
cctgcctacggtcctaaagtgt

SEQ ID NO: 33742 - DNA, 21 bp, Artificial Sequence
  Synthetic Construct
tccctcaaaccccagctcctt

SEQ ID NO: 33743 - DNA, 23 bp, Artificial Sequence
  Synthetic Construct
ggcatgcttttcattgtgagtga

SEQ ID NO: 33744 - DNA, 25 bp, Artificial Sequence
  Synthetic Construct
ggatcttccttctgggtcataaagt

SEQ ID NO: 33745 - DNA, 25 bp, Artificial Sequence
  Synthetic Construct
gcttttaaaaacccagctgtgaatg

SEQ ID NO: 33746 - DNA, 20 bp, Artificial Sequence
  Synthetic Construct
tcttcccgctccgtccctta

SEQ ID NO: 33747 - DNA, 20 bp, Artificial Sequence
  Synthetic Construct
ctgtccgcagaagccaaaag

SEQ ID NO: 33748 - DNA, 23 bp, Artificial Sequence
  Synthetic Construct
ctgtactgcctcctttcctctca

SEQ ID NO: 33749 - DNA, 20 bp, Artificial Sequence
  Synthetic Construct
cctgagcaagggcacagaag

SEQ ID NO: 33750 - DNA, 20 bp, Artificial Sequence
  Synthetic Construct
aggttcatgggccctcattg

SEQ ID NO: 33751 - DNA, 21 bp, Artificial Sequence
  Synthetic Construct
gggctcccactttcctgagat

SEQ ID NO: 33752 - DNA, 26 bp, Artificial Sequence
  Synthetic Construct
gcaggctcgatatctaattccagaga

SEQ ID NO: 33753 - DNA, 20 bp, Artificial Sequence
  Synthetic Construct
gcagaatcgcctgtggttgt

SEQ ID NO: 33754 - DNA, 23 bp, Artificial Sequence
  Synthetic Construct
gagaagctaaatggtccccaaga

SEQ ID NO: 33755 - DNA, 21 bp, Artificial Sequence
  Synthetic Construct
ggactgaggggctctctggaa

SEQ ID NO: 33756 - DNA, 22 bp, Artificial Sequence
  Synthetic Construct
gcccctgtagtacatccacact

SEQ ID NO: 33757 - DNA, 24 bp, Artificial Sequence
  Synthetic Construct
cctttcgcatgaattgtgcagtga

SEQ ID NO: 33758 - DNA, 24 bp, Artificial Sequence
  Synthetic Construct
gagctctagctgtgagtaggatct

SEQ ID NO: 33759 - DNA, 20 bp, Artificial Sequence
  Synthetic Construct
cctctttgccaggtcacaca

SEQ ID NO: 33760 - DNA, 24 bp, Artificial Sequence
  Synthetic Construct
actgggtgaataaaggacccaaga

SEQ ID NO: 33761 - DNA, 18 bp, Artificial Sequence
  Synthetic Construct
agaggctcgtgggtgtga

SEQ ID NO: 33762 - DNA, 19 bp, Artificial Sequence
  Synthetic Construct
tgggctctgctgcctgttg

SEQ ID NO: 33763 - DNA, 20 bp, Artificial Sequence
  Synthetic Construct
gatggtccccagagggatga

SEQ ID NO: 33764 - DNA, 21 bp, Artificial Sequence
  Synthetic Construct
acccctgatgggctcaagtca

SEQ ID NO: 33765 - DNA, 25 bp, Artificial Sequence
  Synthetic Construct
gtcaatactgtggacagctgcttct

SEQ ID NO: 33766 - DNA, 19 bp, Artificial Sequence
  Synthetic Construct
ggaagcatcccgccagcat

SEQ ID NO: 33767 - DNA, 27 bp, Artificial Sequence
  Synthetic Construct
actaggatctatttcaacccagaccat

SEQ ID NO: 33768 - DNA, 22 bp, Artificial Sequence
  Synthetic Construct
gcctctgcctgcaaagaaccat

SEQ ID NO: 33769 - DNA, 26 bp, Artificial Sequence
  Synthetic Construct
gctcaccatcttcctcatcaaacaga

SEQ ID NO: 33770 - DNA, 26 bp, Artificial Sequence
  Synthetic Construct
gggagagacaggttaagaggccattg

SEQ ID NO: 33771 - DNA, 20 bp, Artificial Sequence
  Synthetic Construct
ccagcaagcatggggttcaa

SEQ ID NO: 33772 - DNA, 20 bp, Artificial Sequence
  Synthetic Construct
cgccaggaattcgtgcctta

SEQ ID NO: 33773 - DNA, 24 bp, Artificial Sequence
  Synthetic Construct
ggctctcaaaaccctcaggtctca

SEQ ID NO: 33774 - DNA, 21 bp, Artificial Sequence
  Synthetic Construct
atgcttagtgcctgacacaca

SEQ ID NO: 33775 - DNA, 21 bp, Artificial Sequence
  Synthetic Construct
accgactcctgtccctctttg

SEQ ID NO: 33776 - DNA, 25 bp, Artificial Sequence
  Synthetic Construct
caggaggtggtctttacctcaattc

SEQ ID NO: 33777 - DNA, 26 bp, Artificial Sequence
  Synthetic Construct
caccttagaaaaatgcctacccttga

SEQ ID NO: 33778 - DNA, 29 bp, Artificial Sequence
  Synthetic Construct
ggaaatagatttcagggactagccaaaag

SEQ ID NO: 33779 - DNA, 21 bp, Artificial Sequence
  Synthetic Construct
gccttctcactgctgaacctt

SEQ ID NO: 33780 - DNA, 20 bp, Artificial Sequence
  Synthetic Construct
agcctcctcactgccaaatc

SEQ ID NO: 33781 - DNA, 27 bp, Artificial Sequence
  Synthetic Construct
cccactacacgagaattacacccatct

SEQ ID NO: 33782 - DNA, 21 bp, Artificial Sequence
  Synthetic Construct
tttagcagggcaagggctaag

SEQ ID NO: 33783 - DNA, 29 bp, Artificial Sequence
  Synthetic Construct
cagggaaaaagactgaatcctaactccta

SEQ ID NO: 33784 - DNA, 21 bp, Artificial Sequence
  Synthetic Construct
atgaggacgaggccgggacta

SEQ ID NO: 33785 - DNA, 27 bp, Artificial Sequence
  Synthetic Construct
gagttagatgacccttactttctgcta

SEQ ID NO: 33786 - DNA, 22 bp, Artificial Sequence
  Synthetic Construct
ccattagtggcgcacagacatc

SEQ ID NO: 33787 - DNA, 21 bp, Artificial Sequence
  Synthetic Construct
tcctggctgtcactactgtgt

SEQ ID NO: 33788 - DNA, 21 bp, Artificial Sequence
  Synthetic Construct
ctgggaacaaagccgcctaat

SEQ ID NO: 33789 - DNA, 22 bp, Artificial Sequence
  Synthetic Construct
cgtctccgctgatgttctgtag

SEQ ID NO: 33790 - DNA, 19 bp, Artificial Sequence
  Synthetic Construct
gtgccaactgtggctgtga

SEQ ID NO: 33791 - DNA, 22 bp, Artificial Sequence
  Synthetic Construct
tggctagtggggaagccagata

SEQ ID NO: 33792 - DNA, 24 bp, Artificial Sequence
  Synthetic Construct
ttggtaccagaagtgggattcaaa

SEQ ID NO: 33793 - DNA, 23 bp, Artificial Sequence
  Synthetic Construct
ctgtggtttgtgtaggcccaaag

SEQ ID NO: 33794 - DNA, 21 bp, Artificial Sequence
  Synthetic Construct
gggccaacacatgagggatgt

SEQ ID NO: 33795 - DNA, 22 bp, Artificial Sequence
  Synthetic Construct
ccactggatcactgggtgctta

SEQ ID NO: 33796 - DNA, 21 bp, Artificial Sequence
  Synthetic Construct
tgggacagtgattcccagctt

SEQ ID NO: 33797 - DNA, 20 bp, Artificial Sequence
  Synthetic Construct
agggacagggcagccagtca

SEQ ID NO: 33798 - DNA, 21 bp, Artificial Sequence
  Synthetic Construct
ttatagccgctgcctcctaga

SEQ ID NO: 33799 - DNA, 22 bp, Artificial Sequence
  Synthetic Construct
gctcatccaggaccccatcttt

SEQ ID NO: 33800 - DNA, 20 bp, Artificial Sequence
  Synthetic Construct
ctcattggcgtcagccgata

SEQ ID NO: 33801 - DNA, 24 bp, Artificial Sequence
  Synthetic Construct
cctcgatgttggtagggactcttc

SEQ ID NO: 33802 - DNA, 22 bp, Artificial Sequence
  Synthetic Construct
gcgagtcacctctgccatgttt

SEQ ID NO: 33803 - DNA, 21 bp, Artificial Sequence
  Synthetic Construct
aggccactcagggctttgtga

SEQ ID NO: 33804 - DNA, 28 bp, Artificial Sequence
  Synthetic Construct
ctggggagatgatattaaagctgactct

SEQ ID NO: 33805 - DNA, 20 bp, Artificial Sequence
  Synthetic Construct
gctgcctctgtggtcacatc

SEQ ID NO: 33806 - DNA, 20 bp, Artificial Sequence
  Synthetic Construct
ccaaggcagcacttgaggta

SEQ ID NO: 33807 - DNA, 21 bp, Artificial Sequence
  Synthetic Construct
gccaactgctgtgttgtcttg

SEQ ID NO: 33808 - DNA, 21 bp, Artificial Sequence
  Synthetic Construct
acaacctcacctttgcagaca

SEQ ID NO: 33809 - DNA, 25 bp, Artificial Sequence
  Synthetic Construct
gtcatttgctttcatgaccctcctt

SEQ ID NO: 33810 - DNA, 20 bp, Artificial Sequence
  Synthetic Construct
agtgcgcagcccttttcctt

SEQ ID NO: 33811 - DNA, 19 bp, Artificial Sequence
  Synthetic Construct
atggcgaagcgcaggaaga

SEQ ID NO: 33812 - DNA, 22 bp, Artificial Sequence
  Synthetic Construct
ttgccagaggttccccagattg

SEQ ID NO: 33813 - DNA, 25 bp, Artificial Sequence
  Synthetic Construct
caaataaaggccctccttcaacaac

SEQ ID NO: 33814 - DNA, 22 bp, Artificial Sequence
  Synthetic Construct
caaggaggaggaccaagtctca

SEQ ID NO: 33815 - DNA, 23 bp, Artificial Sequence
  Synthetic Construct
gcatctgtatgcacactgggttt

SEQ ID NO: 33816 - DNA, 20 bp, Artificial Sequence
  Synthetic Construct
aaggtgccagggcaactcaa

SEQ ID NO: 33817 - DNA, 20 bp, Artificial Sequence
  Synthetic Construct
gttctgcagctggtcactgt

SEQ ID NO: 33818 - DNA, 20 bp, Artificial Sequence
  Synthetic Construct
tgctgcagccatgcttccta

SEQ ID NO: 33819 - DNA, 18 bp, Artificial Sequence
  Synthetic Construct
agaagcggctggctccat

SEQ ID NO: 33820 - DNA, 21 bp, Artificial Sequence
  Synthetic Construct
gccttcagggaagctttgaca

SEQ ID NO: 33821 - DNA, 22 bp, Artificial Sequence
  Synthetic Construct
gcagcaccgctctctagttaag

SEQ ID NO: 33822 - DNA, 22 bp, Artificial Sequence
  Synthetic Construct
gacactaagtgcggctgtcatc

SEQ ID NO: 33823 - DNA, 20 bp, Artificial Sequence
  Synthetic Construct
gctaccaggaacgggagtca

SEQ ID NO: 33824 - DNA, 20 bp, Artificial Sequence
  Synthetic Construct
accctgttccctctgtcagt

SEQ ID NO: 33825 - DNA, 22 bp, Artificial Sequence
  Synthetic Construct
gcccagctttagcggatgaagt

SEQ ID NO: 33826 - DNA, 21 bp, Artificial Sequence
  Synthetic Construct
gctgcgcccatttgtttgcat

SEQ ID NO: 33827 - DNA, 19 bp, Artificial Sequence
  Synthetic Construct
ggcacaaagccctctgcat

SEQ ID NO: 33828 - DNA, 21 bp, Artificial Sequence
  Synthetic Construct
tgggcccatggtccatccaaa

SEQ ID NO: 33829 - DNA, 20 bp, Artificial Sequence
  Synthetic Construct
ttgccgctcctctttctgtt

SEQ ID NO: 33830 - DNA, 22 bp, Artificial Sequence
  Synthetic Construct
tcttccccaaatgggaccttca

SEQ ID NO: 33831 - DNA, 24 bp, Artificial Sequence
  Synthetic Construct
ccacatagctctccatctggctat

SEQ ID NO: 33832 - DNA, 21 bp, Artificial Sequence
  Synthetic Construct
ggagtttccgaaggcaacagt

SEQ ID NO: 33833 - DNA, 20 bp, Artificial Sequence
  Synthetic Construct
tcctggcctaaggggtgttt

SEQ ID NO: 33834 - DNA, 20 bp, Artificial Sequence
  Synthetic Construct
gtgctcaggttgtggagaca

SEQ ID NO: 33835 - DNA, 22 bp, Artificial Sequence
  Synthetic Construct
ctcttcaagcaaggctgtctct

SEQ ID NO: 33836 - DNA, 24 bp, Artificial Sequence
  Synthetic Construct
gtgtacagtgaaggccatgtgttc

SEQ ID NO: 33837 - DNA, 23 bp, Artificial Sequence
  Synthetic Construct
tccatggctcaggagggacatag

SEQ ID NO: 33838 - DNA, 22 bp, Artificial Sequence
  Synthetic Construct
accacgatccacacctcctaac

SEQ ID NO: 33839 - DNA, 20 bp, Artificial Sequence
  Synthetic Construct
ttggctggagggctctggaa

SEQ ID NO: 33840 - DNA, 20 bp, Artificial Sequence
  Synthetic Construct
gcaccactggagccaagatt

SEQ ID NO: 33841 - DNA, 25 bp, Artificial Sequence
  Synthetic Construct
gctggaactctgtcataggctgaag

SEQ ID NO: 33842 - DNA, 21 bp, Artificial Sequence
  Synthetic Construct
agtgggagtggtctggtcaac

SEQ ID NO: 33843 - DNA, 20 bp, Artificial Sequence
  Synthetic Construct
actggagcgcttgaggtaga

SEQ ID NO: 33844 - DNA, 24 bp, Artificial Sequence
  Synthetic Construct
gcacaccagaagataacccagctt

SEQ ID NO: 33845 - DNA, 27 bp, Artificial Sequence
  Synthetic Construct
gggcattattgaatgctctgctttctt

SEQ ID NO: 33846 - DNA, 22 bp, Artificial Sequence
  Synthetic Construct
accctggagctcccttccaaaa

SEQ ID NO: 33847 - DNA, 21 bp, Artificial Sequence
  Synthetic Construct
ggcctcctggtgcattgaaac

SEQ ID NO: 33848 - DNA, 24 bp, Artificial Sequence
  Synthetic Construct
gtgcatacacttgactgcttgaca

SEQ ID NO: 33849 - DNA, 21 bp, Artificial Sequence
  Synthetic Construct
tgtaagtgccagccagctaga

SEQ ID NO: 33850 - DNA, 23 bp, Artificial Sequence
  Synthetic Construct
gacctgagtgtggtgaaatgtct

SEQ ID NO: 33851 - DNA, 21 bp, Artificial Sequence
  Synthetic Construct
cagggtgcctcatctcaggat

SEQ ID NO: 33852 - DNA, 22 bp, Artificial Sequence
  Synthetic Construct
agctgaggctatggggatgact

SEQ ID NO: 33853 - DNA, 22 bp, Artificial Sequence
  Synthetic Construct
gcttgtttccacccacctcgtt

SEQ ID NO: 33854 - DNA, 21 bp, Artificial Sequence
  Synthetic Construct
gctgagtgcctttctgccttt

SEQ ID NO: 33855 - DNA, 23 bp, Artificial Sequence
  Synthetic Construct
agtgacagagtatggggtgagaa

SEQ ID NO: 33856 - DNA, 22 bp, Artificial Sequence
  Synthetic Construct
gcttcccagatcccacagttag

SEQ ID NO: 33857 - DNA, 22 bp, Artificial Sequence
  Synthetic Construct
cccaggactgtcattcccaaga

SEQ ID NO: 33858 - DNA, 20 bp, Artificial Sequence
  Synthetic Construct
gggttatgggcaccttcaca

SEQ ID NO: 33859 - DNA, 21 bp, Artificial Sequence
  Synthetic Construct
ggcagacacaacttggggaaa

SEQ ID NO: 33860 - DNA, 21 bp, Artificial Sequence
  Synthetic Construct
gacgtgctcagtgggatttgt

SEQ ID NO: 33861 - DNA, 23 bp, Artificial Sequence
  Synthetic Construct
gcaataacccatcggtggagcaa

SEQ ID NO: 33862 - DNA, 22 bp, Artificial Sequence
  Synthetic Construct
tggtgagatcttggctctccat

SEQ ID NO: 33863 - DNA, 22 bp, Artificial Sequence
  Synthetic Construct
gccctctttccattgcccagaa

SEQ ID NO: 33864 - DNA, 22 bp, Artificial Sequence
  Synthetic Construct
gtctctgtctgcccatcagtct

SEQ ID NO: 33865 - DNA, 20 bp, Artificial Sequence
  Synthetic Construct
gcagggaaagcccagtcatc

SEQ ID NO: 33866 - DNA, 27 bp, Artificial Sequence
  Synthetic Construct
ccccacatttcttcagacagtggaatc

SEQ ID NO: 33867 - DNA, 18 bp, Artificial Sequence
  Synthetic Construct
tcccgcccactgctatct

SEQ ID NO: 33868 - DNA, 19 bp, Artificial Sequence
  Synthetic Construct
tgtctcggggtgccacaca

SEQ ID NO: 33869 - DNA, 23 bp, Artificial Sequence
  Synthetic Construct
gcacgtggagagtgttcatccat

SEQ ID NO: 33870 - DNA, 25 bp, Artificial Sequence
  Synthetic Construct
tgaaatgaacagaccagctaacctt

SEQ ID NO: 33871 - DNA, 22 bp, Artificial Sequence
  Synthetic Construct
cctgggctatgctgtcatccat

SEQ ID NO: 33872 - DNA, 25 bp, Artificial Sequence
  Synthetic Construct
gagactgcctgaataccatggaaga

SEQ ID NO: 33873 - DNA, 20 bp, Artificial Sequence
  Synthetic Construct
tgggagggtgccacctcttg

SEQ ID NO: 33874 - DNA, 20 bp, Artificial Sequence
  Synthetic Construct
ctttggttgcaggccacaga

SEQ ID NO: 33875 - DNA, 20 bp, Artificial Sequence
  Synthetic Construct
ggctgccttgggacacatct

SEQ ID NO: 33876 - DNA, 22 bp, Artificial Sequence
  Synthetic Construct
gccaggaacactgcttgtgatg

SEQ ID NO: 33877 - DNA, 22 bp, Artificial Sequence
  Synthetic Construct
gagaggggtttgcttccctctt

SEQ ID NO: 33878 - DNA, 19 bp, Artificial Sequence
  Synthetic Construct
aggggcctgcactgtgatt

SEQ ID NO: 33879 - DNA, 23 bp, Artificial Sequence
  Synthetic Construct
ccatcagcagattcacactcaga

SEQ ID NO: 33880 - DNA, 24 bp, Artificial Sequence
  Synthetic Construct
cagggaaaacagggatgaaagaca

SEQ ID NO: 33881 - DNA, 26 bp, Artificial Sequence
  Synthetic Construct
ctgctgtgaagctggagactttttac

SEQ ID NO: 33882 - DNA, 19 bp, Artificial Sequence
  Synthetic Construct
tcgccgcgttgaccagtgt

SEQ ID NO: 33883 - DNA, 22 bp, Artificial Sequence
  Synthetic Construct
ggacaggtactaggtgctgctt

SEQ ID NO: 33884 - DNA, 22 bp, Artificial Sequence
  Synthetic Construct
gaagccggtttaactggtgttg

SEQ ID NO: 33885 - DNA, 22 bp, Artificial Sequence
  Synthetic Construct
cagcaggagggaaaaggctatg

SEQ ID NO: 33886 - DNA, 22 bp, Artificial Sequence
  Synthetic Construct
ctcaaaaggcaggtgcttgaca

SEQ ID NO: 33887 - DNA, 21 bp, Artificial Sequence
  Synthetic Construct
tggttcccaaggggctcagat

SEQ ID NO: 33888 - DNA, 26 bp, Artificial Sequence
  Synthetic Construct
gtggtgaaagtaatggcatcaagcat

SEQ ID NO: 33889 - DNA, 21 bp, Artificial Sequence
  Synthetic Construct
tgctgtggtgtggtcatttgt

SEQ ID NO: 33890 - DNA, 20 bp, Artificial Sequence
  Synthetic Construct
tcccagtgcaagggcattag

SEQ ID NO: 33891 - DNA, 19 bp, Artificial Sequence
  Synthetic Construct
aggctggcctcccacttac

SEQ ID NO: 33892 - DNA, 26 bp, Artificial Sequence
  Synthetic Construct
agagtaaacttggaaggatgggtttc

SEQ ID NO: 33893 - DNA, 19 bp, Artificial Sequence
  Synthetic Construct
gcaatccctgcgaccacat

SEQ ID NO: 33894 - DNA, 20 bp, Artificial Sequence
  Synthetic Construct
aggccaaagtccctgtgaac

SEQ ID NO: 33895 - DNA, 25 bp, Artificial Sequence
  Synthetic Construct
ggatgagattcccttcctccacact

SEQ ID NO: 33896 - DNA, 21 bp, Artificial Sequence
  Synthetic Construct
gctgtttctctgtcgctcctt

SEQ ID NO: 33897 - DNA, 22 bp, Artificial Sequence
  Synthetic Construct
gggtgctgggaaacatgaggaa

SEQ ID NO: 33898 - DNA, 22 bp, Artificial Sequence
  Synthetic Construct
cagccttctgtccactccttag

SEQ ID NO: 33899 - DNA, 20 bp, Artificial Sequence
  Synthetic Construct
tgcttccagagccccacact

SEQ ID NO: 33900 - DNA, 20 bp, Artificial Sequence
  Synthetic Construct
cactccgcattgttgtgcat

SEQ ID NO: 33901 - DNA, 20 bp, Artificial Sequence
  Synthetic Construct
acaccctgtggggccgatga

SEQ ID NO: 33902 - DNA, 24 bp, Artificial Sequence
  Synthetic Construct
gtggtagttagacctccccgaaag

SEQ ID NO: 33903 - DNA, 21 bp, Artificial Sequence
  Synthetic Construct
gggcagaagtggatggtgaga

SEQ ID NO: 33904 - DNA, 21 bp, Artificial Sequence
  Synthetic Construct
gcccctaccctgttcctccat

SEQ ID NO: 33905 - DNA, 24 bp, Artificial Sequence
  Synthetic Construct
acttccaggagcacctttgaatag

SEQ ID NO: 33906 - DNA, 26 bp, Artificial Sequence
  Synthetic Construct
ccatcaaagaggtaacaagccagtga

SEQ ID NO: 33907 - DNA, 20 bp, Artificial Sequence
  Synthetic Construct
aaccccgtcttggctcgatt

SEQ ID NO: 33908 - DNA, 19 bp, Artificial Sequence
  Synthetic Construct
gctacacgctgggcaccaa

SEQ ID NO: 33909 - DNA, 22 bp, Artificial Sequence
  Synthetic Construct
gccctatggcaaaggctcacta

SEQ ID NO: 33910 - DNA, 20 bp, Artificial Sequence
  Synthetic Construct
aagcctctggctggtgtttc

SEQ ID NO: 33911 - DNA, 20 bp, Artificial Sequence
  Synthetic Construct
cctgtggttttgggcaggtt

SEQ ID NO: 33912 - DNA, 20 bp, Artificial Sequence
  Synthetic Construct
tggttaccaccctgggatca

SEQ ID NO: 33913 - DNA, 21 bp, Artificial Sequence
  Synthetic Construct
tctggtactcccagggtgcat

SEQ ID NO: 33914 - DNA, 20 bp, Artificial Sequence
  Synthetic Construct
tggatacaccgggcttgtct

SEQ ID NO: 33915 - DNA, 20 bp, Artificial Sequence
  Synthetic Construct
aagacaccgcgctgcctagt

SEQ ID NO: 33916 - DNA, 21 bp, Artificial Sequence
  Synthetic Construct
tccagaggcaggagacaatca

SEQ ID NO: 33917 - DNA, 27 bp, Artificial Sequence
  Synthetic Construct
ccgcaattggagctgaattcttaaatc

SEQ ID NO: 33918 - DNA, 20 bp, Artificial Sequence
  Synthetic Construct
ccttggggtggcccacttag

SEQ ID NO: 33919 - DNA, 21 bp, Artificial Sequence
  Synthetic Construct
ttttccctgacgatcggcttt

SEQ ID NO: 33920 - DNA, 23 bp, Artificial Sequence
  Synthetic Construct
gtcagggagaacctatggaccta

SEQ ID NO: 33921 - DNA, 24 bp, Artificial Sequence
  Synthetic Construct
ccccagacagatgtaagtccaaca

SEQ ID NO: 33922 - DNA, 20 bp, Artificial Sequence
  Synthetic Construct
ctgcatgcctggaacacact

SEQ ID NO: 33923 - DNA, 22 bp, Artificial Sequence
  Synthetic Construct
ctggactgctcactctggaact

SEQ ID NO: 33924 - DNA, 20 bp, Artificial Sequence
  Synthetic Construct
tgcccgaagaggcatgaaac

SEQ ID NO: 33925 - DNA, 23 bp, Artificial Sequence
  Synthetic Construct
tcttctccaaagtcagggtgtct

SEQ ID NO: 33926 - DNA, 20 bp, Artificial Sequence
  Synthetic Construct
gcagtgccaggagcaaaaga

SEQ ID NO: 33927 - DNA, 25 bp, Artificial Sequence
  Synthetic Construct
agccttaaaaactgccttctacaca

SEQ ID NO: 33928 - DNA, 25 bp, Artificial Sequence
  Synthetic Construct
gggattcactagtgttgtggattga

SEQ ID NO: 33929 - DNA, 22 bp, Artificial Sequence
  Synthetic Construct
ccaatggtggaaacagcctaca

SEQ ID NO: 33930 - DNA, 23 bp, Artificial Sequence
  Synthetic Construct
gctagatgagggaggctggaaac

SEQ ID NO: 33931 - DNA, 20 bp, Artificial Sequence
  Synthetic Construct
cctggatgtggctggcagta

SEQ ID NO: 33932 - DNA, 20 bp, Artificial Sequence
  Synthetic Construct
cattggcaacccagctcaca

SEQ ID NO: 33933 - DNA, 21 bp, Artificial Sequence
  Synthetic Construct
agcccgagcctcctacaactt

SEQ ID NO: 33934 - DNA, 20 bp, Artificial Sequence
  Synthetic Construct
acagggctccaggcgagtgt

SEQ ID NO: 33935 - DNA, 21 bp, Artificial Sequence
  Synthetic Construct
tgggaggtgaaccagggacat

SEQ ID NO: 33936 - DNA, 22 bp, Artificial Sequence
  Synthetic Construct
gggctgcagagataagctcgtt

SEQ ID NO: 33937 - DNA, 22 bp, Artificial Sequence
  Synthetic Construct
cgtcacagccagttctcacaca

SEQ ID NO: 33938 - DNA, 20 bp, Artificial Sequence
  Synthetic Construct
tctgacctgcgggcagtttg

SEQ ID NO: 33939 - DNA, 23 bp, Artificial Sequence
  Synthetic Construct
gcgagaaacaccactgacatttg

SEQ ID NO: 33940 - DNA, 22 bp, Artificial Sequence
  Synthetic Construct
cccaatggtagctggcatgctt

SEQ ID NO: 33941 - DNA, 21 bp, Artificial Sequence
  Synthetic Construct
acctccccagggacactcact

SEQ ID NO: 33942 - DNA, 22 bp, Artificial Sequence
  Synthetic Construct
aggcagtggcctcctctttgta

SEQ ID NO: 33943 - DNA, 20 bp, Artificial Sequence
  Synthetic Construct
ttgccggtggatcctgactt

SEQ ID NO: 33944 - DNA, 22 bp, Artificial Sequence
  Synthetic Construct
tgcaattgatcgttggctccta

SEQ ID NO: 33945 - DNA, 22 bp, Artificial Sequence
  Synthetic Construct
ggccgctttcttagggtgtaag

SEQ ID NO: 33946 - DNA, 24 bp, Artificial Sequence
  Synthetic Construct
ggtgaaaggtgaggatcaatcaga

SEQ ID NO: 33947 - DNA, 20 bp, Artificial Sequence
  Synthetic Construct
tgtgccttctgggagaccat

SEQ ID NO: 33948 - DNA, 25 bp, Artificial Sequence
  Synthetic Construct
ggttctccagaatggtcctgtcgtt

SEQ ID NO: 33949 - DNA, 20 bp, Artificial Sequence
  Synthetic Construct
gcagccttagggctagcaaa

SEQ ID NO: 33950 - DNA, 22 bp, Artificial Sequence
  Synthetic Construct
cccctaaacctgggccaaatga

SEQ ID NO: 33951 - DNA, 20 bp, Artificial Sequence
  Synthetic Construct
tgacaggccatgccacaaag

SEQ ID NO: 33952 - DNA, 26 bp, Artificial Sequence
  Synthetic Construct
cccatcctattaccccaaacgtcttc

SEQ ID NO: 33953 - DNA, 20 bp, Artificial Sequence
  Synthetic Construct
actgcagcccctgtgaatac

SEQ ID NO: 33954 - DNA, 23 bp, Artificial Sequence
  Synthetic Construct
ggagacgtcctgcctgcagtctt

SEQ ID NO: 33955 - DNA, 20 bp, Artificial Sequence
  Synthetic Construct
gcgcacagcagaatggagat

SEQ ID NO: 33956 - DNA, 23 bp, Artificial Sequence
  Synthetic Construct
gcatgcagtggtgtatgttgtag

SEQ ID NO: 33957 - DNA, 25 bp, Artificial Sequence
  Synthetic Construct
gcctaatgtttgtggggtagtggta

SEQ ID NO: 33958 - DNA, 20 bp, Artificial Sequence
  Synthetic Construct
gggagaccaggcccctaaga

SEQ ID NO: 33959 - DNA, 20 bp, Artificial Sequence
  Synthetic Construct
tccctgcaaggaccctcagt

SEQ ID NO: 33960 - DNA, 22 bp, Artificial Sequence
  Synthetic Construct
tctcacctgaccctgaggtctt

SEQ ID NO: 33961 - DNA, 22 bp, Artificial Sequence
  Synthetic Construct
gacgcagcttgccttagacttc

SEQ ID NO: 33962 - DNA, 24 bp, Artificial Sequence
  Synthetic Construct
gggtgcagctgacttcctagtctt

SEQ ID NO: 33963 - DNA, 22 bp, Artificial Sequence
  Synthetic Construct
gtgcggtcaaggtttacaggtt

SEQ ID NO: 33964 - DNA, 22 bp, Artificial Sequence
  Synthetic Construct
tcacaagctccactccctcaag

SEQ ID NO: 33965 - DNA, 18 bp, Artificial Sequence
  Synthetic Construct
tctgcgtgtgcgtgtgtt

SEQ ID NO: 33966 - DNA, 21 bp, Artificial Sequence
  Synthetic Construct
cagtgacatgtggcccagttt

SEQ ID NO: 33967 - DNA, 25 bp, Artificial Sequence
  Synthetic Construct
tgttcaatgatactggtgcaggatt

SEQ ID NO: 33968 - DNA, 24 bp, Artificial Sequence
  Synthetic Construct
ggcgtggagttgcttcatctcctt

SEQ ID NO: 33969 - DNA, 19 bp, Artificial Sequence
  Synthetic Construct
tggggtggcacagccaact

SEQ ID NO: 33970 - DNA, 22 bp, Artificial Sequence
  Synthetic Construct
accacgtgacaggtgtgaggat

SEQ ID NO: 33971 - DNA, 24 bp, Artificial Sequence
  Synthetic Construct
ggagtagctctgtagggagagttg

SEQ ID NO: 33972 - DNA, 23 bp, Artificial Sequence
  Synthetic Construct
acatgattgatgccaaggggtaa

SEQ ID NO: 33973 - DNA, 22 bp, Artificial Sequence
  Synthetic Construct
tgcgtgctcagagtcacataag

SEQ ID NO: 33974 - DNA, 20 bp, Artificial Sequence
  Synthetic Construct
agcacacccctcctgcactt

SEQ ID NO: 33975 - DNA, 19 bp, Artificial Sequence
  Synthetic Construct
ccaggcggctccaagaagt

SEQ ID NO: 33976 - DNA, 20 bp, Artificial Sequence
  Synthetic Construct
aaacctggcagaggttgcat

SEQ ID NO: 33977 - DNA, 22 bp, Artificial Sequence
  Synthetic Construct
caggatctgaacgggaggtttc

SEQ ID NO: 33978 - DNA, 24 bp, Artificial Sequence
  Synthetic Construct
ggtggaaatctaccccaggcaact

SEQ ID NO: 33979 - DNA, 22 bp, Artificial Sequence
  Synthetic Construct
ctgccggtgaactgagagtaga

SEQ ID NO: 33980 - DNA, 19 bp, Artificial Sequence
  Synthetic Construct
atccctggccatgctgcta

SEQ ID NO: 33981 - DNA, 24 bp, Artificial Sequence
  Synthetic Construct
agtgactcatcctgaagtcctgaa

SEQ ID NO: 33982 - DNA, 20 bp, Artificial Sequence
  Synthetic Construct
acaggaaggcaccacgttga

SEQ ID NO: 33983 - DNA, 19 bp, Artificial Sequence
  Synthetic Construct
gaggggccaagtgcagaag

SEQ ID NO: 33984 - DNA, 21 bp, Artificial Sequence
  Synthetic Construct
agaggtgaccaggccctttga

SEQ ID NO: 33985 - DNA, 22 bp, Artificial Sequence
  Synthetic Construct
gtgacgcgacctgctcataagt

SEQ ID NO: 33986 - DNA, 22 bp, Artificial Sequence
  Synthetic Construct
acctgggctccatcctgtgaat

SEQ ID NO: 33987 - DNA, 23 bp, Artificial Sequence
  Synthetic Construct
gctcaattcctcccactgcttct

SEQ ID NO: 33988 - DNA, 22 bp, Artificial Sequence
  Synthetic Construct
ctcttctggagaaggggagagt

SEQ ID NO: 33989 - DNA, 27 bp, Artificial Sequence
  Synthetic Construct
gtccaactccttccatctgaattcttc

SEQ ID NO: 33990 - DNA, 24 bp, Artificial Sequence
  Synthetic Construct
cacgtaggcctctgttttctggtt

SEQ ID NO: 33991 - DNA, 22 bp, Artificial Sequence
  Synthetic Construct
cccctggctaagctcaaagtca

SEQ ID NO: 33992 - DNA, 22 bp, Artificial Sequence
  Synthetic Construct
ggaaaacacaccgccagagaag

SEQ ID NO: 33993 - DNA, 23 bp, Artificial Sequence
  Synthetic Construct
gcaaactcctaggctctgtgctt

SEQ ID NO: 33994 - DNA, 23 bp, Artificial Sequence
  Synthetic Construct
gtgagaggatgtgtgcgttccat

SEQ ID NO: 33995 - DNA, 23 bp, Artificial Sequence
  Synthetic Construct
cattaccccagttggcagaaaac

SEQ ID NO: 33996 - DNA, 22 bp, Artificial Sequence
  Synthetic Construct
gacaagttgggtggacagtctt

SEQ ID NO: 33997 - DNA, 19 bp, Artificial Sequence
  Synthetic Construct
aaggggtgctctcccttga

SEQ ID NO: 33998 - DNA, 23 bp, Artificial Sequence
  Synthetic Construct
ccccgtgaaatgatggtggaaac

SEQ ID NO: 33999 - DNA, 25 bp, Artificial Sequence
  Synthetic Construct
ggtaatcaaccctcagtctctcatc

SEQ ID NO: 34000 - DNA, 19 bp, Artificial Sequence
  Synthetic Construct
aggccagccctctgacttc

SEQ ID NO: 34001 - DNA, 20 bp, Artificial Sequence
  Synthetic Construct
gcttgggactctggggttga

SEQ ID NO: 34002 - DNA, 21 bp, Artificial Sequence
  Synthetic Construct
cctggctttgccccttcatct

SEQ ID NO: 34003 - DNA, 18 bp, Artificial Sequence
  Synthetic Construct
agccagcctctgcacctt

SEQ ID NO: 34004 - DNA, 21 bp, Artificial Sequence
  Synthetic Construct
cctctgaaaggcggaaaccaa

SEQ ID NO: 34005 - DNA, 18 bp, Artificial Sequence
  Synthetic Construct
agtggccagcaggagcaa

SEQ ID NO: 34006 - DNA, 23 bp, Artificial Sequence
  Synthetic Construct
ccagggcaggactctaaccattg

SEQ ID NO: 34007 - DNA, 24 bp, Artificial Sequence
  Synthetic Construct
gttaggaaagggtcccctaaggtt

SEQ ID NO: 34008 - DNA, 20 bp, Artificial Sequence
  Synthetic Construct
ggtggcttggattgcctact

SEQ ID NO: 34009 - DNA, 20 bp, Artificial Sequence
  Synthetic Construct
tccaccctggccccagcatt

SEQ ID NO: 34010 - DNA, 21 bp, Artificial Sequence
  Synthetic Construct
cgtggaggggaggaagtcttg

SEQ ID NO: 34011 - DNA, 20 bp, Artificial Sequence
  Synthetic Construct
accaatgggaggcaccatca

SEQ ID NO: 34012 - DNA, 24 bp, Artificial Sequence
  Synthetic Construct
gagttgcacttgtactctgtcagt

SEQ ID NO: 34013 - DNA, 25 bp, Artificial Sequence
  Synthetic Construct
ggctttttggctttccaggttgatg

SEQ ID NO: 34014 - DNA, 20 bp, Artificial Sequence
  Synthetic Construct
cccgcaagggttggggaaat

SEQ ID NO: 34015 - DNA, 20 bp, Artificial Sequence
  Synthetic Construct
tccaacaccatccgctcttc

SEQ ID NO: 34016 - DNA, 22 bp, Artificial Sequence
  Synthetic Construct
gtgggtgccagagttgagattc

SEQ ID NO: 34017 - DNA, 19 bp, Artificial Sequence
  Synthetic Construct
ggccgggaaaagggagcat

SEQ ID NO: 34018 - DNA, 28 bp, Artificial Sequence
  Synthetic Construct
gtcttccccatagttaagttgtctcttc

SEQ ID NO: 34019 - DNA, 28 bp, Artificial Sequence
  Synthetic Construct
gcagctacgcatacaaatcactcacatc

SEQ ID NO: 34020 - DNA, 21 bp, Artificial Sequence
  Synthetic Construct
actggactcagggagcagcat

SEQ ID NO: 34021 - DNA, 19 bp, Artificial Sequence
  Synthetic Construct
aggccactgcctcgcatca

SEQ ID NO: 34022 - DNA, 25 bp, Artificial Sequence
  Synthetic Construct
ggacttttgttttccccgtttgaag

SEQ ID NO: 34023 - DNA, 25 bp, Artificial Sequence
  Synthetic Construct
tctaaatgttctctgggtgctgttc

SEQ ID NO: 34024 - DNA, 22 bp, Artificial Sequence
  Synthetic Construct
ggggtctaatggctgtggttgt

SEQ ID NO: 34025 - DNA, 22 bp, Artificial Sequence
  Synthetic Construct
ggctgttagccctgtggaacaa

SEQ ID NO: 34026 - DNA, 20 bp, Artificial Sequence
  Synthetic Construct
acggcagagcaaaggcttgt

SEQ ID NO: 34027 - DNA, 28 bp, Artificial Sequence
  Synthetic Construct
ggacaaggccctttaattcataccaaga

SEQ ID NO: 34028 - DNA, 18 bp, Artificial Sequence
  Synthetic Construct
agcccagagcagcgttca

SEQ ID NO: 34029 - DNA, 21 bp, Artificial Sequence
  Synthetic Construct
tggtagtgtagaggggcaact

SEQ ID NO: 34030 - DNA, 20 bp, Artificial Sequence
  Synthetic Construct
gggccaagcgttcagactac

SEQ ID NO: 34031 - DNA, 18 bp, Artificial Sequence
  Synthetic Construct
atgctcaggctgcgttgt

SEQ ID NO: 34032 - DNA, 21 bp, Artificial Sequence
  Synthetic Construct
tggctccctgaggagtgtttg

SEQ ID NO: 34033 - DNA, 25 bp, Artificial Sequence
  Synthetic Construct
cagaaaagtctagtgaagccagaca

SEQ ID NO: 34034 - DNA, 22 bp, Artificial Sequence
  Synthetic Construct
cacagacaactggagggtgaac

SEQ ID NO: 34035 - DNA, 23 bp, Artificial Sequence
  Synthetic Construct
acatacctgctgtaccccaaatg

SEQ ID NO: 34036 - DNA, 24 bp, Artificial Sequence
  Synthetic Construct
gcaatgaacaacgacaggctttca

SEQ ID NO: 34037 - DNA, 22 bp, Artificial Sequence
  Synthetic Construct
gactgagcttgtgaggcaggaa

SEQ ID NO: 34038 - DNA, 25 bp, Artificial Sequence
  Synthetic Construct
gcatactaaaggagctttggagaca

SEQ ID NO: 34039 - DNA, 19 bp, Artificial Sequence
  Synthetic Construct
gccaaccaggccagcatca

SEQ ID NO: 34040 - DNA, 21 bp, Artificial Sequence
  Synthetic Construct
acagagcggtacagcggaatc

SEQ ID NO: 34041 - DNA, 26 bp, Artificial Sequence
  Synthetic Construct
gagaaagtgagcatttgccatgaaag

SEQ ID NO: 34042 - DNA, 26 bp, Artificial Sequence
  Synthetic Construct
ggtcttaccttcagagttctgtccta

SEQ ID NO: 34043 - DNA, 27 bp, Artificial Sequence
  Synthetic Construct
ggggaacatttcagaccagataacact

SEQ ID NO: 34044 - DNA, 20 bp, Artificial Sequence
  Synthetic Construct
agggccaatcctggaacact

SEQ ID NO: 34045 - DNA, 29 bp, Artificial Sequence
  Synthetic Construct
ccttgcaccaaaaatagaagtgtgagcta

SEQ ID NO: 34046 - DNA, 18 bp, Artificial Sequence
  Synthetic Construct
actgccaagtggctgcaa

SEQ ID NO: 34047 - DNA, 22 bp, Artificial Sequence
  Synthetic Construct
cacagctgaacctcaggcaatc

SEQ ID NO: 34048 - DNA, 22 bp, Artificial Sequence
  Synthetic Construct
caacagccgggatcttctgaac

SEQ ID NO: 34049 - DNA, 24 bp, Artificial Sequence
  Synthetic Construct
gggcctaggtgtgtgtatccagtt

SEQ ID NO: 34050 - DNA, 25 bp, Artificial Sequence
  Synthetic Construct
cctgtcggaatgttttctccaccaa

SEQ ID NO: 34051 - DNA, 22 bp, Artificial Sequence
  Synthetic Construct
gggtctaaggacaccgggtcta

SEQ ID NO: 34052 - DNA, 21 bp, Artificial Sequence
  Synthetic Construct
tttccggtggggccaatgtgt

SEQ ID NO: 34053 - DNA, 23 bp, Artificial Sequence
  Synthetic Construct
gcattgtcaggcttctctctttg

SEQ ID NO: 34054 - DNA, 25 bp, Artificial Sequence
  Synthetic Construct
cagaaatcagaagctctcagggaaa

SEQ ID NO: 34055 - DNA, 24 bp, Artificial Sequence
  Synthetic Construct
actcttttgcctgggatttaccat

SEQ ID NO: 34056 - DNA, 20 bp, Artificial Sequence
  Synthetic Construct
atctggcccgtgctccactt

SEQ ID NO: 34057 - DNA, 19 bp, Artificial Sequence
  Synthetic Construct
aacacctggggaggcaaca

SEQ ID NO: 34058 - DNA, 19 bp, Artificial Sequence
  Synthetic Construct
aggcagggagcacagagat

SEQ ID NO: 34059 - DNA, 23 bp, Artificial Sequence
  Synthetic Construct
ggttttggggcatagtccacagt

SEQ ID NO: 34060 - DNA, 20 bp, Artificial Sequence
  Synthetic Construct
cctcccctcccagcatgaag

SEQ ID NO: 34061 - DNA, 22 bp, Artificial Sequence
  Synthetic Construct
tccctgggtggtctgtctgatt

SEQ ID NO: 34062 - DNA, 22 bp, Artificial Sequence
  Synthetic Construct
ccccatcccattgcttctcagt

SEQ ID NO: 34063 - DNA, 21 bp, Artificial Sequence
  Synthetic Construct
tggcttcaaggtagggaggtt

SEQ ID NO: 34064 - DNA, 19 bp, Artificial Sequence
  Synthetic Construct
ggagggtggcagtgtggta

SEQ ID NO: 34065 - DNA, 23 bp, Artificial Sequence
  Synthetic Construct
gctgtatccagggaggtgacaag

SEQ ID NO: 34066 - DNA, 25 bp, Artificial Sequence
  Synthetic Construct
cctgcgtgtcaaatactcctttcta

SEQ ID NO: 34067 - DNA, 24 bp, Artificial Sequence
  Synthetic Construct
gctgttgtggttaagagcctggat

SEQ ID NO: 34068 - DNA, 23 bp, Artificial Sequence
  Synthetic Construct
accaggcatagtggagataggaa

SEQ ID NO: 34069 - DNA, 20 bp, Artificial Sequence
  Synthetic Construct
tgccggcctcccagtctcat

SEQ ID NO: 34070 - DNA, 19 bp, Artificial Sequence
  Synthetic Construct
tgctcgggcagggtgagaa

SEQ ID NO: 34071 - DNA, 22 bp, Artificial Sequence
  Synthetic Construct
ggcacccgtttggccttaattg

SEQ ID NO: 34072 - DNA, 20 bp, Artificial Sequence
  Synthetic Construct
tggtgggcaggagaggctaa

SEQ ID NO: 34073 - DNA, 22 bp, Artificial Sequence
  Synthetic Construct
aagtgggtgctacagaagcatt

SEQ ID NO: 34074 - DNA, 27 bp, Artificial Sequence
  Synthetic Construct
gggctaagaatgagtgattgggtcata

SEQ ID NO: 34075 - DNA, 22 bp, Artificial Sequence
  Synthetic Construct
ttcaggctctgagacacgaaag

SEQ ID NO: 34076 - DNA, 20 bp, Artificial Sequence
  Synthetic Construct
actcctgaccgagggaatgt

SEQ ID NO: 34077 - DNA, 22 bp, Artificial Sequence
  Synthetic Construct
cccaaaggaaaccatcccatgt

SEQ ID NO: 34078 - DNA, 22 bp, Artificial Sequence
  Synthetic Construct
cacaggttccctcccacttact

SEQ ID NO: 34079 - DNA, 22 bp, Artificial Sequence
  Synthetic Construct
agccggggaatgtcctgtattc

SEQ ID NO: 34080 - DNA, 25 bp, Artificial Sequence
  Synthetic Construct
ccttctgatgcttggataccgcaaa

SEQ ID NO: 34081 - DNA, 23 bp, Artificial Sequence
  Synthetic Construct
gcagatcaggattgcaggctttg

SEQ ID NO: 34082 - DNA, 21 bp, Artificial Sequence
  Synthetic Construct
ggcctcagaagccaggataag

SEQ ID NO: 34083 - DNA, 22 bp, Artificial Sequence
  Synthetic Construct
ggtttcgctcatgcctctgttg

SEQ ID NO: 34084 - DNA, 20 bp, Artificial Sequence
  Synthetic Construct
ttcctgagagggctgtgcta

SEQ ID NO: 34085 - DNA, 21 bp, Artificial Sequence
  Synthetic Construct
accagctccttcctcccttct

SEQ ID NO: 34086 - DNA, 21 bp, Artificial Sequence
  Synthetic Construct
gcacagctaggaatgggaaca

SEQ ID NO: 34087 - DNA, 27 bp, Artificial Sequence
  Synthetic Construct
gctaatgctcaaagggaaaagtgtctt

SEQ ID NO: 34088 - DNA, 24 bp, Artificial Sequence
  Synthetic Construct
gtggcattgtggaaacaagcaaag

SEQ ID NO: 34089 - DNA, 22 bp, Artificial Sequence
  Synthetic Construct
cctgccagcagggcatttttct

SEQ ID NO: 34090 - DNA, 21 bp, Artificial Sequence
  Synthetic Construct
cctcagatggctgagggaaga

SEQ ID NO: 34091 - DNA, 20 bp, Artificial Sequence
  Synthetic Construct
gttcaggcctgcagggaaaa

SEQ ID NO: 34092 - DNA, 26 bp, Artificial Sequence
  Synthetic Construct
gggtacaaatagcctttacagcattg

SEQ ID NO: 34093 - DNA, 22 bp, Artificial Sequence
  Synthetic Construct
aggcagcttaggccactagtct

SEQ ID NO: 34094 - DNA, 25 bp, Artificial Sequence
  Synthetic Construct
gaactccacccagttctaaggatag

SEQ ID NO: 34095 - DNA, 22 bp, Artificial Sequence
  Synthetic Construct
ccctggaagaaggagagggaat

SEQ ID NO: 34096 - DNA, 21 bp, Artificial Sequence
  Synthetic Construct
agggcagtgagcactgagttg

SEQ ID NO: 34097 - DNA, 21 bp, Artificial Sequence
  Synthetic Construct
atccccacggacaccaacgat

SEQ ID NO: 34098 - DNA, 21 bp, Artificial Sequence
  Synthetic Construct
gcagccattccctcaccacat

SEQ ID NO: 34099 - DNA, 19 bp, Artificial Sequence
  Synthetic Construct
ccccgggcaaacacatact

SEQ ID NO: 34100 - DNA, 20 bp, Artificial Sequence
  Synthetic Construct
atcctggtcctgggcagtaa

SEQ ID NO: 34101 - DNA, 22 bp, Artificial Sequence
  Synthetic Construct
accaggtgccagctccctatac

SEQ ID NO: 34102 - DNA, 24 bp, Artificial Sequence
  Synthetic Construct
gtggagcaggactagctgagaatc

SEQ ID NO: 34103 - DNA, 23 bp, Artificial Sequence
  Synthetic Construct
gccagaaatccacaccatacaag

SEQ ID NO: 34104 - DNA, 24 bp, Artificial Sequence
  Synthetic Construct
ggggacagtttcaagtggatgaga

SEQ ID NO: 34105 - DNA, 21 bp, Artificial Sequence
  Synthetic Construct
aggtgagggcttgaggcagtt

SEQ ID NO: 34106 - DNA, 23 bp, Artificial Sequence
  Synthetic Construct
tgagggaaaccaaaactgcattc

SEQ ID NO: 34107 - DNA, 22 bp, Artificial Sequence
  Synthetic Construct
aggccttttccactctccctta

SEQ ID NO: 34108 - DNA, 24 bp, Artificial Sequence
  Synthetic Construct
cccttacaaaccacagatgcaaag

SEQ ID NO: 34109 - DNA, 24 bp, Artificial Sequence
  Synthetic Construct
cactcttaggaagggagtgtctgt

SEQ ID NO: 34110 - DNA, 22 bp, Artificial Sequence
  Synthetic Construct
atagggaagtggtgtggtcaac

SEQ ID NO: 34111 - DNA, 18 bp, Artificial Sequence
  Synthetic Construct
tccctgcctgggtcttgt

SEQ ID NO: 34112 - DNA, 22 bp, Artificial Sequence
  Synthetic Construct
caggagctgaggctttggtttg

SEQ ID NO: 34113 - DNA, 22 bp, Artificial Sequence
  Synthetic Construct
tgttttctgtgtgccagtgtgt

SEQ ID NO: 34114 - DNA, 20 bp, Artificial Sequence
  Synthetic Construct
gcagggttcaggccagtaga

SEQ ID NO: 34115 - DNA, 22 bp, Artificial Sequence
  Synthetic Construct
agctgggatggagggacattga

SEQ ID NO: 34116 - DNA, 27 bp, Artificial Sequence
  Synthetic Construct
ggtgtacaattgctggatcctaagaca

SEQ ID NO: 34117 - DNA, 22 bp, Artificial Sequence
  Synthetic Construct
cagcctccaggcaaatttccaa

SEQ ID NO: 34118 - DNA, 23 bp, Artificial Sequence
  Synthetic Construct
gcaagtttggccatctcttgtga

SEQ ID NO: 34119 - DNA, 25 bp, Artificial Sequence
  Synthetic Construct
cgtccatgaaggaatagctggtgtt

SEQ ID NO: 34120 - DNA, 23 bp, Artificial Sequence
  Synthetic Construct
acccggctatacgagaactcttt

SEQ ID NO: 34121 - DNA, 25 bp, Artificial Sequence
  Synthetic Construct
gttcatgaaagtgaaagagccatga

SEQ ID NO: 34122 - DNA, 23 bp, Artificial Sequence
  Synthetic Construct
gggacaaaatcggctccttcaga

SEQ ID NO: 34123 - DNA, 20 bp, Artificial Sequence
  Synthetic Construct
atgccctgaatcgcccttgt

SEQ ID NO: 34124 - DNA, 21 bp, Artificial Sequence
  Synthetic Construct
cccacacctcttgccaaggaa

SEQ ID NO: 34125 - DNA, 20 bp, Artificial Sequence
  Synthetic Construct
gcccatgggtaaggcaggaa

SEQ ID NO: 34126 - DNA, 19 bp, Artificial Sequence
  Synthetic Construct
actggccggtggtcctgtt

SEQ ID NO: 34127 - DNA, 22 bp, Artificial Sequence
  Synthetic Construct
cgctgtcctggaagtgttgttc

SEQ ID NO: 34128 - DNA, 21 bp, Artificial Sequence
  Synthetic Construct
tggcccacagaaagggtctca

SEQ ID NO: 34129 - DNA, 24 bp, Artificial Sequence
  Synthetic Construct
tctctggttaacagatgccagatg

SEQ ID NO: 34130 - DNA, 22 bp, Artificial Sequence
  Synthetic Construct
cccaaaaggctctgaggtcatc

SEQ ID NO: 34131 - DNA, 21 bp, Artificial Sequence
  Synthetic Construct
ggacatgactccctgggacaa

SEQ ID NO: 34132 - DNA, 20 bp, Artificial Sequence
  Synthetic Construct
tgtcttagctgcgcctctgt

SEQ ID NO: 34133 - DNA, 19 bp, Artificial Sequence
  Synthetic Construct
gccaagggcaggtgggata

SEQ ID NO: 34134 - DNA, 25 bp, Artificial Sequence
  Synthetic Construct
cctttccaactccatcatctggtta

SEQ ID NO: 34135 - DNA, 25 bp, Artificial Sequence
  Synthetic Construct
cctgcctgataccttcttgatgact

SEQ ID NO: 34136 - DNA, 22 bp, Artificial Sequence
  Synthetic Construct
ggcctaaaggccaaggagtgaa

SEQ ID NO: 34137 - DNA, 20 bp, Artificial Sequence
  Synthetic Construct
cactgcttagcgacctgtgt

SEQ ID NO: 34138 - DNA, 20 bp, Artificial Sequence
  Synthetic Construct
tggtcagcgtgaagctctgt

SEQ ID NO: 34139 - DNA, 20 bp, Artificial Sequence
  Synthetic Construct
aggctccacaggaggtcatt

SEQ ID NO: 34140 - DNA, 25 bp, Artificial Sequence
  Synthetic Construct
tgtgaaagaaagggcagacattgta

SEQ ID NO: 34141 - DNA, 22 bp, Artificial Sequence
  Synthetic Construct
ccagtgtgggatctcaggcatt

SEQ ID NO: 34142 - DNA, 25 bp, Artificial Sequence
  Synthetic Construct
gaatttactctgaccaccacaccta

SEQ ID NO: 34143 - DNA, 19 bp, Artificial Sequence
  Synthetic Construct
tgctgtgtgcagggactgt

SEQ ID NO: 34144 - DNA, 22 bp, Artificial Sequence
  Synthetic Construct
tcaggtgacaggtggggtaaca

SEQ ID NO: 34145 - DNA, 20 bp, Artificial Sequence
  Synthetic Construct
gaaaccaactgccggagact

SEQ ID NO: 34146 - DNA, 20 bp, Artificial Sequence
  Synthetic Construct
aaggaagtggccgcagtatg

SEQ ID NO: 34147 - DNA, 19 bp, Artificial Sequence
  Synthetic Construct
agcgctgggccatgtcatt

SEQ ID NO: 34148 - DNA, 27 bp, Artificial Sequence
  Synthetic Construct
ggttagttccctttattgccccaagat

SEQ ID NO: 34149 - DNA, 23 bp, Artificial Sequence
  Synthetic Construct
gtgtgcagttggtaaaggcaaag

SEQ ID NO: 34150 - DNA, 24 bp, Artificial Sequence
  Synthetic Construct
gtgattttccagcacctcccacta

SEQ ID NO: 34151 - DNA, 27 bp, Artificial Sequence
  Synthetic Construct
gggaaaccctgtaataactcactctgt

SEQ ID NO: 34152 - DNA, 23 bp, Artificial Sequence
  Synthetic Construct
gtcagtgcttttcatggcatctt

SEQ ID NO: 34153 - DNA, 24 bp, Artificial Sequence
  Synthetic Construct
aaattactccatggtgggaagtgt

SEQ ID NO: 34154 - DNA, 22 bp, Artificial Sequence
  Synthetic Construct
gcctgattgaacccctacaaca

SEQ ID NO: 34155 - DNA, 19 bp, Artificial Sequence
  Synthetic Construct
cggcgtccaggagacagtt

SEQ ID NO: 34156 - DNA, 23 bp, Artificial Sequence
  Synthetic Construct
ccagggtctttccaagagcattc

SEQ ID NO: 34157 - DNA, 25 bp, Artificial Sequence
  Synthetic Construct
gtttctcaggataagcagctcaaac

SEQ ID NO: 34158 - DNA, 20 bp, Artificial Sequence
  Synthetic Construct
tgaccaggcagagggctgat

SEQ ID NO: 34159 - DNA, 21 bp, Artificial Sequence
  Synthetic Construct
ttggccacccagagcagtcat

SEQ ID NO: 34160 - DNA, 21 bp, Artificial Sequence
  Synthetic Construct
gcagtgatgcgatgtgagtct

SEQ ID NO: 34161 - DNA, 27 bp, Artificial Sequence
  Synthetic Construct
gaaacctaaggatatcaaagggctgat

SEQ ID NO: 34162 - DNA, 22 bp, Artificial Sequence
  Synthetic Construct
caggcccaataggcccatttac

SEQ ID NO: 34163 - DNA, 22 bp, Artificial Sequence
  Synthetic Construct
ctgggtcagctcaagtggattg

SEQ ID NO: 34164 - DNA, 20 bp, Artificial Sequence
  Synthetic Construct
tgtgccgctgtgtgacattc

SEQ ID NO: 34165 - DNA, 22 bp, Artificial Sequence
  Synthetic Construct
gcccaggcatccaatccctaag

SEQ ID NO: 34166 - DNA, 23 bp, Artificial Sequence
  Synthetic Construct
tgatgtgcctctcttgttccaat

SEQ ID NO: 34167 - DNA, 21 bp, Artificial Sequence
  Synthetic Construct
aggaactctggggagatgcaa

SEQ ID NO: 34168 - DNA, 22 bp, Artificial Sequence
  Synthetic Construct
cgttgctgcaatcaaggtgttg

SEQ ID NO: 34169 - DNA, 25 bp, Artificial Sequence
  Synthetic Construct
gacacctcctctatcctgtggaatg

SEQ ID NO: 34170 - DNA, 25 bp, Artificial Sequence
  Synthetic Construct
aaaggtaatgtccattcggctagat

SEQ ID NO: 34171 - DNA, 29 bp, Artificial Sequence
  Synthetic Construct
cggagaaaattggttttcctatcggtgtt

SEQ ID NO: 34172 - DNA, 20 bp, Artificial Sequence
  Synthetic Construct
gcactaaacgccagggtgat

SEQ ID NO: 34173 - DNA, 21 bp, Artificial Sequence
  Synthetic Construct
aaaggggacctgccaccttca

SEQ ID NO: 34174 - DNA, 22 bp, Artificial Sequence
  Synthetic Construct
tggtgtcagcctcgttccttct

SEQ ID NO: 34175 - DNA, 20 bp, Artificial Sequence
  Synthetic Construct
caccacacaggtgcatcaca

SEQ ID NO: 34176 - DNA, 22 bp, Artificial Sequence
  Synthetic Construct
cccattgccaaaagcaaactgt

SEQ ID NO: 34177 - DNA, 20 bp, Artificial Sequence
  Synthetic Construct
agggccacagcagaggagat

SEQ ID NO: 34178 - DNA, 23 bp, Artificial Sequence
  Synthetic Construct
ctgcgtttgtgttcaggctaaag

SEQ ID NO: 34179 - DNA, 21 bp, Artificial Sequence
  Synthetic Construct
atgttcccaggccctgctctt

SEQ ID NO: 34180 - DNA, 20 bp, Artificial Sequence
  Synthetic Construct
cacgcggaactagcaaccta

SEQ ID NO: 34181 - DNA, 21 bp, Artificial Sequence
  Synthetic Construct
atgtgctgcctaccccacttg

SEQ ID NO: 34182 - DNA, 18 bp, Artificial Sequence
  Synthetic Construct
tgggtgcaccaggagtgt

SEQ ID NO: 34183 - DNA, 25 bp, Artificial Sequence
  Synthetic Construct
ctcagggactaagtgtctctgacaa

SEQ ID NO: 34184 - DNA, 28 bp, Artificial Sequence
  Synthetic Construct
cctaaatacagggagtgggatgtagaag

SEQ ID NO: 34185 - DNA, 23 bp, Artificial Sequence
  Synthetic Construct
gcttcctccaccccgtgattaag

SEQ ID NO: 34186 - DNA, 22 bp, Artificial Sequence
  Synthetic Construct
ggagaacctccgaccacagaaa

SEQ ID NO: 34187 - DNA, 20 bp, Artificial Sequence
  Synthetic Construct
agtccccagggaggcagctt

SEQ ID NO: 34188 - DNA, 18 bp, Artificial Sequence
  Synthetic Construct
accccagagcctgctgtt

SEQ ID NO: 34189 - DNA, 23 bp, Artificial Sequence
  Synthetic Construct
ctcgagctgaacacttgtgtgat

SEQ ID NO: 34190 - DNA, 19 bp, Artificial Sequence
  Synthetic Construct
tggaagggacgcccgcaat

SEQ ID NO: 34191 - DNA, 22 bp, Artificial Sequence
  Synthetic Construct
atttggcctggaggggctgagt

SEQ ID NO: 34192 - DNA, 22 bp, Artificial Sequence
  Synthetic Construct
gaagtcagtggtcagagcatca

SEQ ID NO: 34193 - DNA, 22 bp, Artificial Sequence
  Synthetic Construct
caccgtgtctctaagggtcagt

SEQ ID NO: 34194 - DNA, 24 bp, Artificial Sequence
  Synthetic Construct
ggagccacagaattagcacagtca

SEQ ID NO: 34195 - DNA, 24 bp, Artificial Sequence
  Synthetic Construct
cagatttggctggcatttcagaag

SEQ ID NO: 34196 - DNA, 24 bp, Artificial Sequence
  Synthetic Construct
cctgtctgcttttgtgtcaacagt

SEQ ID NO: 34197 - DNA, 20 bp, Artificial Sequence
  Synthetic Construct
agagaggtgagacggtgcaa

SEQ ID NO: 34198 - DNA, 21 bp, Artificial Sequence
  Synthetic Construct
cgacaggggagcaggagagat

SEQ ID NO: 34199 - DNA, 24 bp, Artificial Sequence
  Synthetic Construct
gctggatggtctaggatggcttca

SEQ ID NO: 34200 - DNA, 22 bp, Artificial Sequence
  Synthetic Construct
ccaacttcagcacatgcacttc

SEQ ID NO: 34201 - DNA, 20 bp, Artificial Sequence
  Synthetic Construct
gcacgcacctcttgcaaatc

SEQ ID NO: 34202 - DNA, 26 bp, Artificial Sequence
  Synthetic Construct
cacaccttttctcaggtacaccttca

SEQ ID NO: 34203 - DNA, 19 bp, Artificial Sequence
  Synthetic Construct
tggcgtctgcactcactca

SEQ ID NO: 34204 - DNA, 20 bp, Artificial Sequence
  Synthetic Construct
gctatgaggcagtgcgtgtt

SEQ ID NO: 34205 - DNA, 20 bp, Artificial Sequence
  Synthetic Construct
agatggggcagcagcattca

SEQ ID NO: 34206 - DNA, 24 bp, Artificial Sequence
  Synthetic Construct
ctcatgacctttgcatttgctgat

SEQ ID NO: 34207 - DNA, 20 bp, Artificial Sequence
  Synthetic Construct
tgcctcccactcttggtgtt

SEQ ID NO: 34208 - DNA, 22 bp, Artificial Sequence
  Synthetic Construct
ggcttctgcacccctaagtttg

SEQ ID NO: 34209 - DNA, 20 bp, Artificial Sequence
  Synthetic Construct
cttgctgtgccccttccaat

SEQ ID NO: 34210 - DNA, 22 bp, Artificial Sequence
  Synthetic Construct
agtacaggccacaggggatgaa

SEQ ID NO: 34211 - DNA, 23 bp, Artificial Sequence
  Synthetic Construct
aaaagccacaaagatgggtcaag

SEQ ID NO: 34212 - DNA, 22 bp, Artificial Sequence
  Synthetic Construct
gcagccctgaattggaagttct

SEQ ID NO: 34213 - DNA, 21 bp, Artificial Sequence
  Synthetic Construct
cccattcccacagagcaggaa

SEQ ID NO: 34214 - DNA, 22 bp, Artificial Sequence
  Synthetic Construct
cccacaggagcaggtgttttag

SEQ ID NO: 34215 - DNA, 24 bp, Artificial Sequence
  Synthetic Construct
cagtaaatggtgaggccacagttg

SEQ ID NO: 34216 - DNA, 20 bp, Artificial Sequence
  Synthetic Construct
accaaccagtggacccagat

SEQ ID NO: 34217 - DNA, 30 bp, Artificial Sequence; identical to SEQ ID NO: 2991
  Synthetic Construct

SEQ ID NO: 34218 - DNA, 23 bp, Artificial Sequence
  Synthetic Construct
ggtccttccatgtccctcagtct

SEQ ID NO: 34219 - DNA, 20 bp, Artificial Sequence
  Synthetic Construct
tcctgtggctgaaggacaga

SEQ ID NO: 34220 - DNA, 20 bp, Artificial Sequence
  Synthetic Construct
aactgagcgaggggctttgt

SEQ ID NO: 34221 - DNA, 19 bp, Artificial Sequence
  Synthetic Construct
ggagccacaggggatggaa

SEQ ID NO: 34222 - DNA, 20 bp, Artificial Sequence
  Synthetic Construct
tccagcaggctgaggcattg

SEQ ID NO: 34223 - DNA, 20 bp, Artificial Sequence
  Synthetic Construct
tcctggtccgggagaacgat

SEQ ID NO: 34224 - DNA, 20 bp, Artificial Sequence
  Synthetic Construct
agggaagcctgcatgtctct

SEQ ID NO: 34225 - DNA, 22 bp, Artificial Sequence
  Synthetic Construct
gtctggaacccgcacaacttac

SEQ ID NO: 34226 - DNA, 23 bp, Artificial Sequence
  Synthetic Construct
tgggtttttccaccatagcaaga

SEQ ID NO: 34227 - DNA, 19 bp, Artificial Sequence
  Synthetic Construct
ggaccgcacggtgtcttct

SEQ ID NO: 34228 - DNA, 20 bp, Artificial Sequence
  Synthetic Construct
ggtgggtcccttgtgagcat

SEQ ID NO: 34229 - DNA, 24 bp, Artificial Sequence
  Synthetic Construct
cacctcgttcatatccaggtgagt

SEQ ID NO: 34230 - DNA, 20 bp, Artificial Sequence
  Synthetic Construct
tggaactgcaccagcacaga

SEQ ID NO: 34231 - DNA, 19 bp, Artificial Sequence
  Synthetic Construct
gtaccctccagcccaggaa

SEQ ID NO: 34232 - DNA, 20 bp, Artificial Sequence
  Synthetic Construct
aggaggggctcagcatggat

SEQ ID NO: 34233 - DNA, 19 bp, Artificial Sequence
  Synthetic Construct
tggacgtgcagacctcaca

SEQ ID NO: 34234 - DNA, 24 bp, Artificial Sequence
  Synthetic Construct
tcaaggaaatgcagtggtatgtgt

SEQ ID NO: 34235 - DNA, 25 bp, Artificial Sequence
  Synthetic Construct
gggcagtgggtaagaagaacccatt

SEQ ID NO: 34236 - DNA, 20 bp, Artificial Sequence
  Synthetic Construct
taggccacggagccacttta

SEQ ID NO: 34237 - DNA, 24 bp, Artificial Sequence
  Synthetic Construct
cgcttctgtttaatgccttagcaa

SEQ ID NO: 34238 - DNA, 25 bp, Artificial Sequence
  Synthetic Construct
gggcgagtttcagaacaagggaaag

SEQ ID NO: 34239 - DNA, 24 bp, Artificial Sequence
  Synthetic Construct
ctgtatctgtgggcttttccttca

SEQ ID NO: 34240 - DNA, 23 bp, Artificial Sequence
  Synthetic Construct
tctatcccatggaagggcaaaag

SEQ ID NO: 34241 - DNA, 25 bp, Artificial Sequence
  Synthetic Construct
tcaaaacagagtctcactgtcactt

SEQ ID NO: 34242 - DNA, 20 bp, Artificial Sequence
  Synthetic Construct
ggccctctctgggcactttg

SEQ ID NO: 34243 - DNA, 21 bp, Artificial Sequence
  Synthetic Construct
cctcatattgctccgccacaa

SEQ ID NO: 34244 - DNA, 20 bp, Artificial Sequence
  Synthetic Construct
ccttgttctccggcgatgtt

SEQ ID NO: 34245 - DNA, 27 bp, Artificial Sequence
  Synthetic Construct
ctgatgtgtaccccgaaatcattgaac

SEQ ID NO: 34246 - DNA, 25 bp, Artificial Sequence
  Synthetic Construct
ggctcctccatttccttccacctaa

SEQ ID NO: 34247 - DNA, 26 bp, Artificial Sequence
  Synthetic Construct
cacatcagaaacgtttgggctgatac

SEQ ID NO: 34248 - DNA, 21 bp, Artificial Sequence
  Synthetic Construct
tcgggccagcccagatttact

SEQ ID NO: 34249 - DNA, 25 bp, Artificial Sequence
  Synthetic Construct
caagaatttccctgtctggaaccaa

SEQ ID NO: 34250 - DNA, 22 bp, Artificial Sequence
  Synthetic Construct
ggccagcccagagtagtaacaa

SEQ ID NO: 34251 - DNA, 22 bp, Artificial Sequence
  Synthetic Construct
gacagagggctaaggtcagcaa

SEQ ID NO: 34252 - DNA, 21 bp, Artificial Sequence
  Synthetic Construct
cagccatcaccacagaagtca

SEQ ID NO: 34253 - DNA, 20 bp, Artificial Sequence
  Synthetic Construct
tgccaggtgctggagaaaga

SEQ ID NO: 34254 - DNA, 25 bp, Artificial Sequence
  Synthetic Construct
agcatacccttagctctacttcaca

SEQ ID NO: 34255 - DNA, 24 bp, Artificial Sequence
  Synthetic Construct
cctttgttgttgctcttccagttc

SEQ ID NO: 34256 - DNA, 20 bp, Artificial Sequence
  Synthetic Construct
cagtttccccagccttgctt

SEQ ID NO: 34257 - DNA, 20 bp, Artificial Sequence
  Synthetic Construct
ttcactgaggggcagggaat

SEQ ID NO: 34258 - DNA, 28 bp, Artificial Sequence
  Synthetic Construct
ggccaacttggtgtaaaaatcccttgaa

SEQ ID NO: 34259 - DNA, 24 bp, Artificial Sequence
  Synthetic Construct
gagttaccagtgaggtgtggaaac

SEQ ID NO: 34260 - DNA, 20 bp, Artificial Sequence
  Synthetic Construct
cgcctccacggcttgattga

SEQ ID NO: 34261 - DNA, 29 bp, Artificial Sequence
  Synthetic Construct
ggcaccaacactaaaaatcaacccgaaga

SEQ ID NO: 34262 - DNA, 22 bp, Artificial Sequence
  Synthetic Construct
tgctttcttgggcatgggaata

SEQ ID NO: 34263 - DNA, 22 bp, Artificial Sequence
  Synthetic Construct
aagcctgagggcaggagacttg

SEQ ID NO: 34264 - DNA, 24 bp, Artificial Sequence
  Synthetic Construct
gcagaatagccagcagttttgaag

SEQ ID NO: 34265 - DNA, 23 bp, Artificial Sequence
  Synthetic Construct
gcagctacttgcaaggtctgagt

SEQ ID NO: 34266 - DNA, 24 bp, Artificial Sequence
  Synthetic Construct
cctccattctggatgccacttttg

SEQ ID NO: 34267 - DNA, 23 bp, Artificial Sequence
  Synthetic Construct
gcacttcaccaagctctgtctca

SEQ ID NO: 34268 - DNA, 24 bp, Artificial Sequence
  Synthetic Construct
ggcgtggaaggatgtctaacaagt

SEQ ID NO: 34269 - DNA, 20 bp, Artificial Sequence
  Synthetic Construct
ccaaatgggcaggtgggaaa

SEQ ID NO: 34270 - DNA, 20 bp, Artificial Sequence
  Synthetic Construct
actcctgggctcaagcaatc

SEQ ID NO: 34271 - DNA, 21 bp, Artificial Sequence
  Synthetic Construct
ctgcattgtcagtccctctgt

SEQ ID NO: 34272 - DNA, 24 bp, Artificial Sequence
  Synthetic Construct
gcagaagttatagcagggatgaca

SEQ ID NO: 34273 - DNA, 23 bp, Artificial Sequence
  Synthetic Construct
ccagcaacctttttggagtgttt

SEQ ID NO: 34274 - DNA, 23 bp, Artificial Sequence
  Synthetic Construct
aacagcttgatgtcttccctgaa

SEQ ID NO: 34275 - DNA, 25 bp, Artificial Sequence
  Synthetic Construct
ggacagaacaatatcctggtgagaa

SEQ ID NO: 34276 - DNA, 24 bp, Artificial Sequence
  Synthetic Construct
ccaccagagcaggtcttctacaac

SEQ ID NO: 34277 - DNA, 25 bp, Artificial Sequence
  Synthetic Construct
ccaaatgtgaggatcaacccaggaa

SEQ ID NO: 34278 - DNA, 24 bp, Artificial Sequence
  Synthetic Construct
ggagctaaggccagaaggtagttc

SEQ ID NO: 34279 - DNA, 20 bp, Artificial Sequence
  Synthetic Construct
acagagtgggctggcacata

SEQ ID NO: 34280 - DNA, 20 bp, Artificial Sequence
  Synthetic Construct
gtgtgttcagggcgacaaca

SEQ ID NO: 34281 - DNA, 20 bp, Artificial Sequence
  Synthetic Construct
gccgcccctctcttttctca

SEQ ID NO: 34282 - DNA, 20 bp, Artificial Sequence
  Synthetic Construct
gaatggggctgcactgcata

SEQ ID NO: 34283 - DNA, 24 bp, Artificial Sequence
  Synthetic Construct
ttcaccacactagtaaggcaaagt

SEQ ID NO: 34284 - DNA, 27 bp, Artificial Sequence
  Synthetic Construct
gtgagaatccattggaaatctgagcat

SEQ ID NO: 34285 - DNA, 26 bp, Artificial Sequence
  Synthetic Construct
gggccctgaataaccaatagcgatac

SEQ ID NO: 34286 - DNA, 21 bp, Artificial Sequence
  Synthetic Construct
gccaggagaggaaggccattt

SEQ ID NO: 34287 - DNA, 20 bp, Artificial Sequence
  Synthetic Construct
caaagctgcccttggtctgt

SEQ ID NO: 34288 - DNA, 27 bp, Artificial Sequence
  Synthetic Construct
ggccttaaagaggacatcgagagaaag

SEQ ID NO: 34289 - DNA, 21 bp, Artificial Sequence
  Synthetic Construct
tatggctccaccctgcctaac

SEQ ID NO: 34290 - DNA, 22 bp, Artificial Sequence
  Synthetic Construct
gggtggtgaggtttggtggaaa

SEQ ID NO: 34291 - DNA, 24 bp, Artificial Sequence
  Synthetic Construct
ggagacaaacagaccaagcgaaca

SEQ ID NO: 34292 - DNA, 22 bp, Artificial Sequence
  Synthetic Construct
gctctctcactgggatggacta

SEQ ID NO: 34293 - DNA, 27 bp, Artificial Sequence
  Synthetic Construct
acaacctaggaagaattagggcttttc

SEQ ID NO: 34294 - DNA, 21 bp, Artificial Sequence
  Synthetic Construct
cctaccccaggacagaagcat

SEQ ID NO: 34295 - DNA, 25 bp, Artificial Sequence
  Synthetic Construct
gtcaaggataggcaagagacgaagt

SEQ ID NO: 34296 - DNA, 21 bp, Artificial Sequence
  Synthetic Construct
ctgaagcaagctgggtgaagt

SEQ ID NO: 34297 - DNA, 24 bp, Artificial Sequence
  Synthetic Construct
ggtccccaaattctctgccagttg

SEQ ID NO: 34298 - DNA, 23 bp, Artificial Sequence
  Synthetic Construct
ccggaaagaatcggcctccttag

SEQ ID NO: 34299 - DNA, 25 bp, Artificial Sequence
  Synthetic Construct
gaaaaagagctgaacaaacggaaac

SEQ ID NO: 34300 - DNA, 20 bp, Artificial Sequence
  Synthetic Construct
tgctgctccagccataggtt

SEQ ID NO: 34301 - DNA, 20 bp, Artificial Sequence
  Synthetic Construct
aacaccctgggaggcatagt

SEQ ID NO: 34302 - DNA, 22 bp, Artificial Sequence
  Synthetic Construct
ggccctccaaactcatggaagt

SEQ ID NO: 34303 - DNA, 24 bp, Artificial Sequence
  Synthetic Construct
gctctcacaaaggaggttcaaaga

SEQ ID NO: 34304 - DNA, 25 bp, Artificial Sequence
  Synthetic Construct
catgcctatctcccttagtcctact

SEQ ID NO: 34305 - DNA, 21 bp, Artificial Sequence
  Synthetic Construct
agtcagctcaggggtgacctt

SEQ ID NO: 34306 - DNA, 21 bp, Artificial Sequence
  Synthetic Construct
ccacagcactgactgccatct

SEQ ID NO: 34307 - DNA, 24 bp, Artificial Sequence
  Synthetic Construct
acatgctgaaagccaaaacctcta

SEQ ID NO: 34308 - DNA, 24 bp, Artificial Sequence
  Synthetic Construct
cagaatagcacagagtgtcacaga

SEQ ID NO: 34309 - DNA, 22 bp, Artificial Sequence
  Synthetic Construct
ccacatcctgccataggagcta

SEQ ID NO: 34310 - DNA, 20 bp, Artificial Sequence
  Synthetic Construct
tagggcaaagagcgcctagt

SEQ ID NO: 34311 - DNA, 27 bp, Artificial Sequence
  Synthetic Construct
ggaattctgtaagctaagaagccaagt

SEQ ID NO: 34312 - DNA, 20 bp, Artificial Sequence
  Synthetic Construct
gctcccaaccccagaacact

SEQ ID NO: 34313 - DNA, 22 bp, Artificial Sequence
  Synthetic Construct
ggcattccagcagtgaccatag

SEQ ID NO: 34314 - DNA, 23 bp, Artificial Sequence
  Synthetic Construct
ccatgggcacaatccaagcctat

SEQ ID NO: 34315 - DNA, 19 bp, Artificial Sequence
  Synthetic Construct
ggggccctttctggaggta

SEQ ID NO: 34316 - DNA, 19 bp, Artificial Sequence
  Synthetic Construct
aacggcaggtgagcagtct

SEQ ID NO: 34317 - DNA, 25 bp, Artificial Sequence
  Synthetic Construct
gtggttgctttcaccctacttcttc

SEQ ID NO: 34318 - DNA, 21 bp, Artificial Sequence
  Synthetic Construct
gactcctggcttggaacagaa

SEQ ID NO: 34319 - DNA, 27 bp, Artificial Sequence
  Synthetic Construct
gcaaagatgacataagcaaaggcttga

SEQ ID NO: 34320 - DNA, 25 bp, Artificial Sequence
  Synthetic Construct
ggagtatcactttagcactggagtt

SEQ ID NO: 34321 - DNA, 20 bp, Artificial Sequence
  Synthetic Construct
aggatcggtcaggccagtgt

SEQ ID NO: 34322 - DNA, 18 bp, Artificial Sequence
  Synthetic Construct
tccaagccaccgccatca

SEQ ID NO: 34323 - DNA, 26 bp, Artificial Sequence
  Synthetic Construct
cctccactctaccaaagcttataaca

SEQ ID NO: 34324 - DNA, 21 bp, Artificial Sequence
  Synthetic Construct
tacgctgaccaccctgacact

SEQ ID NO: 34325 - DNA, 23 bp, Artificial Sequence
  Synthetic Construct
gtgggtactactctgtgcaggaa

SEQ ID NO: 34326 - DNA, 25 bp, Artificial Sequence
  Synthetic Construct
tgaggcatttgagtcaaggtgatac

SEQ ID NO: 34327 - DNA, 20 bp, Artificial Sequence
  Synthetic Construct
tgcctgggttaaggcgcata

SEQ ID NO: 34328 - DNA, 29 bp, Artificial Sequence
  Synthetic Construct
gggaaccttactgatcactagtacaaaac

SEQ ID NO: 34329 - DNA, 22 bp, Artificial Sequence
  Synthetic Construct
ctcctgacacatgcccagtaaa

SEQ ID NO: 34330 - DNA, 19 bp, Artificial Sequence
  Synthetic Construct
agtgtggggccacctggaa

SEQ ID NO: 34331 - DNA, 21 bp, Artificial Sequence
  Synthetic Construct
atgtccggtcggaggtacagt

SEQ ID NO: 34332 - DNA, 23 bp, Artificial Sequence
  Synthetic Construct
aatactgccctccccggactaca

SEQ ID NO: 34333 - DNA, 22 bp, Artificial Sequence
  Synthetic Construct
cactgcagcaaaggctttcaac

SEQ ID NO: 34334 - DNA, 23 bp, Artificial Sequence
  Synthetic Construct
ctcagctctgtgcctggataatg

SEQ ID NO: 34335 - DNA, 25 bp, Artificial Sequence
  Synthetic Construct
ctgatgaattgctggggtggttaag

SEQ ID NO: 34336 - DNA, 26 bp, Artificial Sequence
  Synthetic Construct
ggtttaggtcctccatagtgagcata

SEQ ID NO: 34337 - DNA, 25 bp, Artificial Sequence
  Synthetic Construct
cgggttctttcttgacaggggatct

SEQ ID NO: 34338 - DNA, 20 bp, Artificial Sequence
  Synthetic Construct
aggcttcccctggtgactgt

SEQ ID NO: 34339 - DNA, 20 bp, Artificial Sequence
  Synthetic Construct
agagctggcaggctcaagta

SEQ ID NO: 34340 - DNA, 20 bp, Artificial Sequence
  Synthetic Construct
ctggggcctgcagtttgatt

SEQ ID NO: 34341 - DNA, 22 bp, Artificial Sequence
  Synthetic Construct
gcagcctgaatcttggcagaca

SEQ ID NO: 34342 - DNA, 30 bp, Artificial Sequence; identical to SEQ ID NO: 3116
  Synthetic Construct

SEQ ID NO: 34343 - DNA, 21 bp, Artificial Sequence
  Synthetic Construct
tctcaccttagcctcccaagt

SEQ ID NO: 34344 - DNA, 21 bp, Artificial Sequence
  Synthetic Construct
tggctgccctccttccatgat

SEQ ID NO: 34345 - DNA, 25 bp, Artificial Sequence
  Synthetic Construct
cccaggagtgtatcttggtcctaca

SEQ ID NO: 34346 - DNA, 23 bp, Artificial Sequence
  Synthetic Construct
gcggattttgaagccagagatga

SEQ ID NO: 34347 - DNA, 23 bp, Artificial Sequence
  Synthetic Construct
ccatatgagctctccctgtgcta

SEQ ID NO: 34348 - DNA, 20 bp, Artificial Sequence
  Synthetic Construct
gcgtggtgcagatggtgttt

SEQ ID NO: 34349 - DNA, 20 bp, Artificial Sequence
  Synthetic Construct
tggtctcctggaagctcctt

SEQ ID NO: 34350 - DNA, 24 bp, Artificial Sequence
  Synthetic Construct
tgtaaaacagggaagatgcactca

SEQ ID NO: 34351 - DNA, 25 bp, Artificial Sequence
  Synthetic Construct
cctcctgtgaggatcaaagttcaag

SEQ ID NO: 34352 - DNA, 20 bp, Artificial Sequence
  Synthetic Construct
ggaaaatccgccaccagcat

SEQ ID NO: 34353 - DNA, 22 bp, Artificial Sequence
  Synthetic Construct
agcagtcagtcagttccagcta

SEQ ID NO: 34354 - DNA, 23 bp, Artificial Sequence
  Synthetic Construct
cctcaatgattaccggggctttc

SEQ ID NO: 34355 - DNA, 20 bp, Artificial Sequence
  Synthetic Construct
ggctctcttggccacaggtt

SEQ ID NO: 34356 - DNA, 23 bp, Artificial Sequence
  Synthetic Construct
cacgcccagaatcaaagccaaag

SEQ ID NO: 34357 - DNA, 24 bp, Artificial Sequence
  Synthetic Construct
cctcttagctgtccctcttgtttc

SEQ ID NO: 34358 - DNA, 20 bp, Artificial Sequence
  Synthetic Construct
acacaccccacagcttcttc

SEQ ID NO: 34359 - DNA, 21 bp, Artificial Sequence
  Synthetic Construct
ggctggagggcaaatctgtgt

SEQ ID NO: 34360 - DNA, 24 bp, Artificial Sequence
  Synthetic Construct
gccatcacagaggggttacaggtt

SEQ ID NO: 34361 - DNA, 27 bp, Artificial Sequence
  Synthetic Construct
tcactaagtataaggcctagcctacaa

SEQ ID NO: 34362 - DNA, 25 bp, Artificial Sequence
  Synthetic Construct
gggtccaatgtgaaaagcacagagt

SEQ ID NO: 34363 - DNA, 22 bp, Artificial Sequence
  Synthetic Construct
caaggccataaggccaatgagt

SEQ ID NO: 34364 - DNA, 21 bp, Artificial Sequence
  Synthetic Construct
cctgaggtgaggggtgctagt

SEQ ID NO: 34365 - DNA, 25 bp, Artificial Sequence
  Synthetic Construct
ggcatgctcttcagggagaagttag

SEQ ID NO: 34366 - DNA, 22 bp, Artificial Sequence
  Synthetic Construct
tgtccccagcaccagtaagttc

SEQ ID NO: 34367 - DNA, 24 bp, Artificial Sequence
  Synthetic Construct
gcgggaattggacacagactggta

SEQ ID NO: 34368 - DNA, 27 bp, Artificial Sequence
  Synthetic Construct
ggcttcttcaactccaagtccaggata

SEQ ID NO: 34369 - DNA, 22 bp, Artificial Sequence
  Synthetic Construct
gggctccattgtgttcctcaac

SEQ ID NO: 34370 - DNA, 23 bp, Artificial Sequence
  Synthetic Construct
ggttctgagggagcaaacctctt

SEQ ID NO: 34371 - DNA, 25 bp, Artificial Sequence
  Synthetic Construct
accctcttaattgctttggggtttt

SEQ ID NO: 34372 - DNA, 24 bp, Artificial Sequence
  Synthetic Construct
cgtggagaggtattttggcagtgt

SEQ ID NO: 34373 - DNA, 27 bp, Artificial Sequence
  Synthetic Construct
ggctgatttctgctgtccttcaagcta

SEQ ID NO: 34374 - DNA, 23 bp, Artificial Sequence
  Synthetic Construct
cagttgcctgcatcttgatctgt

SEQ ID NO: 34375 - DNA, 24 bp, Artificial Sequence
  Synthetic Construct
gcactggtggaagagacagcaaag

SEQ ID NO: 34376 - DNA, 20 bp, Artificial Sequence
  Synthetic Construct
acccatgacagccgactctt

SEQ ID NO: 34377 - DNA, 24 bp, Artificial Sequence
  Synthetic Construct
ccttagaaggcctctcttctctgt

SEQ ID NO: 34378 - DNA, 23 bp, Artificial Sequence
  Synthetic Construct
cggtctgaacggaaactgccata

SEQ ID NO: 34379 - DNA, 21 bp, Artificial Sequence
  Synthetic Construct
accctggtctgccttgccttt

SEQ ID NO: 34380 - DNA, 22 bp, Artificial Sequence
  Synthetic Construct
gctcaatcgaggcaggactaac

SEQ ID NO: 34381 - DNA, 22 bp, Artificial Sequence
  Synthetic Construct
ggagttggcccagaacttccat

SEQ ID NO: 34382 - DNA, 23 bp, Artificial Sequence
  Synthetic Construct
ctaagggcttggagaagagcaaa

SEQ ID NO: 34383 - DNA, 21 bp, Artificial Sequence
  Synthetic Construct
agccaaccaggacccagaagt

SEQ ID NO: 34384 - DNA, 23 bp, Artificial Sequence
  Synthetic Construct
agacacatttgcatgcctaccat

SEQ ID NO: 34385 - DNA, 30 bp, Artificial Sequence; identical to SEQ ID NO: 3159
  Synthetic Construct

SEQ ID NO: 34386 - DNA, 24 bp, Artificial Sequence
  Synthetic Construct
gcagccaaaagggcttgttaaatg

SEQ ID NO: 34387 - DNA, 22 bp, Artificial Sequence
  Synthetic Construct
tgggtaccagttaagccacagt

SEQ ID NO: 34388 - DNA, 24 bp, Artificial Sequence
  Synthetic Construct
agagggacttatgtgcagtgaatg

SEQ ID NO: 34389 - DNA, 23 bp, Artificial Sequence
  Synthetic Construct
gctggttttctcacaagcctaga

SEQ ID NO: 34390 - DNA, 21 bp, Artificial Sequence
  Synthetic Construct
agactgcctgctgtttcatca

SEQ ID NO: 34391 - DNA, 21 bp, Artificial Sequence
  Synthetic Construct
gcaggggctgtaaagggtgta

SEQ ID NO: 34392 - DNA, 23 bp, Artificial Sequence
  Synthetic Construct
ctgggtcttctatggccttgttg

SEQ ID NO: 34393 - DNA, 22 bp, Artificial Sequence
  Synthetic Construct
ggtgcctcacttcatagtgtca

SEQ ID NO: 34394 - DNA, 23 bp, Artificial Sequence
  Synthetic Construct
agatggagggcagatttcagaag

SEQ ID NO: 34395 - DNA, 23 bp, Artificial Sequence
  Synthetic Construct
cacacagagcctgggcttatatc

SEQ ID NO: 34396 - DNA, 25 bp, Artificial Sequence
  Synthetic Construct
gcctgggatctctgaagaacagttg

SEQ ID NO: 34397 - DNA, 25 bp, Artificial Sequence
  Synthetic Construct
ccctttgtaaagcatggccctatac

SEQ ID NO: 34398 - DNA, 25 bp, Artificial Sequence
  Synthetic Construct
ttctcatacacaggtgatagcaaca

SEQ ID NO: 34399 - DNA, 21 bp, Artificial Sequence
  Synthetic Construct
cctctttgcccttgggtggaa

SEQ ID NO: 34400 - DNA, 19 bp, Artificial Sequence
  Synthetic Construct
gttgttggccaggcaccat

SEQ ID NO: 34401 - DNA, 21 bp, Artificial Sequence
  Synthetic Construct
ccctggctactgcccatgttt

SEQ ID NO: 34402 - DNA, 22 bp, Artificial Sequence
  Synthetic Construct
gccttgctgtcagctccaatgt

SEQ ID NO: 34403 - DNA, 22 bp, Artificial Sequence
  Synthetic Construct
catctttgtggggctggagttc

SEQ ID NO: 34404 - DNA, 20 bp, Artificial Sequence
  Synthetic Construct
gagcccacatcccgtgaaca

SEQ ID NO: 34405 - DNA, 20 bp, Artificial Sequence
  Synthetic Construct
gaatgtgtccgccagtctgt

SEQ ID NO: 34406 - DNA, 23 bp, Artificial Sequence
  Synthetic Construct
cctggaagccagctagaaaccat

SEQ ID NO: 34407 - DNA, 22 bp, Artificial Sequence
  Synthetic Construct
ggagaggaagacagtggcatct

SEQ ID NO: 34408 - DNA, 22 bp, Artificial Sequence
  Synthetic Construct
gggtgaatgccggtagttgtga

SEQ ID NO: 34409 - DNA, 20 bp, Artificial Sequence
  Synthetic Construct
agccgggcgtacttcctttt

SEQ ID NO: 34410 - DNA, 22 bp, Artificial Sequence
  Synthetic Construct
gctgtatgtctgcaggtcaagt

SEQ ID NO: 34411 - DNA, 24 bp, Artificial Sequence
  Synthetic Construct
tcctcacatgagagtttcctgttc

SEQ ID NO: 34412 - DNA, 22 bp, Artificial Sequence
  Synthetic Construct
ctccagcatctggaaggagaca

SEQ ID NO: 34413 - DNA, 20 bp, Artificial Sequence
  Synthetic Construct
cgggaggcttgcctgagaaa

SEQ ID NO: 34414 - DNA, 20 bp, Artificial Sequence
  Synthetic Construct
tagccagctcccacacacaa

SEQ ID NO: 34415 - DNA, 21 bp, Artificial Sequence
  Synthetic Construct
tgggcgtagcacaagaaatca

SEQ ID NO: 34416 - DNA, 22 bp, Artificial Sequence
  Synthetic Construct
tgggttgctctttgctgttcaa

SEQ ID NO: 34417 - DNA, 24 bp, Artificial Sequence
  Synthetic Construct
gtggcaaacaactctgaggctaac

SEQ ID NO: 34418 - DNA, 24 bp, Artificial Sequence
  Synthetic Construct
gggaagaatgctgtgtcctcacaa

SEQ ID NO: 34419 - DNA, 20 bp, Artificial Sequence
  Synthetic Construct
atttcctgccgtgccacctt

SEQ ID NO: 34420 - DNA, 20 bp, Artificial Sequence
  Synthetic Construct
cacagaaagctggggcaaca

SEQ ID NO: 34421 - DNA, 23 bp, Artificial Sequence
  Synthetic Construct
ccagtacatgctttcccaacaca

SEQ ID NO: 34422 - DNA, 27 bp, Artificial Sequence
  Synthetic Construct
cctttttaaaggagtggatgcagaagt

SEQ ID NO: 34423 - DNA, 23 bp, Artificial Sequence
  Synthetic Construct
gagccccaaatgtacactagcaa

SEQ ID NO: 34424 - DNA, 27 bp, Artificial Sequence
  Synthetic Construct
gcccagtgcttttcttaattgctttga

SEQ ID NO: 34425 - DNA, 23 bp, Artificial Sequence
  Synthetic Construct
ccactggactactggactacact

SEQ ID NO: 34426 - DNA, 24 bp, Artificial Sequence
  Synthetic Construct
caatagccagggtctgaattgcat

SEQ ID NO: 34427 - DNA, 23 bp, Artificial Sequence
  Synthetic Construct
gagtgcagaagaatgggttctga

SEQ ID NO: 34428 - DNA, 20 bp, Artificial Sequence
  Synthetic Construct
aagccctaaacccgcgttac

SEQ ID NO: 34429 - DNA, 25 bp, Artificial Sequence
  Synthetic Construct
agcagaaatcacacaatggcaatac

SEQ ID NO: 34430 - DNA, 20 bp, Artificial Sequence
  Synthetic Construct
tgccttcactgcctggtgat

SEQ ID NO: 34431 - DNA, 20 bp, Artificial Sequence
  Synthetic Construct
accctccccgccatcaagta

SEQ ID NO: 34432 - DNA, 27 bp, Artificial Sequence
  Synthetic Construct
cgtctttctccagtttctgagccctat

SEQ ID NO: 34433 - DNA, 25 bp, Artificial Sequence
  Synthetic Construct
ggtcagctgtgtcaataaggactga

SEQ ID NO: 34434 - DNA, 20 bp, Artificial Sequence
  Synthetic Construct
ggaagcaggtgtcagtgtga

SEQ ID NO: 34435 - DNA, 24 bp, Artificial Sequence
  Synthetic Construct
ggtctgcttctggagtctgcagtt

SEQ ID NO: 34436 - DNA, 25 bp, Artificial Sequence
  Synthetic Construct
cacactcggttcctgtttcaggatt

SEQ ID NO: 34437 - DNA, 25 bp, Artificial Sequence
  Synthetic Construct
acacccatcccaaagggattaaaag

SEQ ID NO: 34438 - DNA, 22 bp, Artificial Sequence
  Synthetic Construct
cctgtctcccttgccagatcaa

SEQ ID NO: 34439 - DNA, 23 bp, Artificial Sequence
  Synthetic Construct
aggcttccctgagcagagatatt

SEQ ID NO: 34440 - DNA, 20 bp, Artificial Sequence
  Synthetic Construct
tctctggctccagcgtctga

SEQ ID NO: 34441 - DNA, 19 bp, Artificial Sequence
  Synthetic Construct
agggatatggccggcttct

SEQ ID NO: 34442 - DNA, 20 bp, Artificial Sequence
  Synthetic Construct
gtggtggtggttgtgctact

SEQ ID NO: 34443 - DNA, 24 bp, Artificial Sequence
  Synthetic Construct
ccttccttttcactaagcctgtct

SEQ ID NO: 34444 - DNA, 24 bp, Artificial Sequence
  Synthetic Construct
gagagattggaaggggagagattg

SEQ ID NO: 34445 - DNA, 26 bp, Artificial Sequence
  Synthetic Construct
ggtggagtaaaaacagcactggacta

SEQ ID NO: 34446 - DNA, 25 bp, Artificial Sequence
  Synthetic Construct
ccttcagggcagtgagttctcttct

SEQ ID NO: 34447 - DNA, 22 bp, Artificial Sequence
  Synthetic Construct
tccaggaaaaggaactgcaaca

SEQ ID NO: 34448 - DNA, 26 bp, Artificial Sequence
  Synthetic Construct
cgcatgtgtaccttaatgatgtcaac

SEQ ID NO: 34449 - DNA, 21 bp, Artificial Sequence
  Synthetic Construct
ccctgaatgttccaccagctt

SEQ ID NO: 34450 - DNA, 23 bp, Artificial Sequence
  Synthetic Construct
gcctccagagctagggatggtta

SEQ ID NO: 34451 - DNA, 19 bp, Artificial Sequence
  Synthetic Construct
tggaggggaccgggttcta

SEQ ID NO: 34452 - DNA, 24 bp, Artificial Sequence
  Synthetic Construct
cctggatttgtctcctgtcacttc

SEQ ID NO: 34453 - DNA, 24 bp, Artificial Sequence
  Synthetic Construct
ggggacacgtcttactgtagtctt

SEQ ID NO: 34454 - DNA, 22 bp, Artificial Sequence
  Synthetic Construct
tcagcaggaaaagcacttgact

SEQ ID NO: 34455 - DNA, 24 bp, Artificial Sequence
  Synthetic Construct
gtttccttccttgtttgcagagtt

SEQ ID NO: 34456 - DNA, 27 bp, Artificial Sequence
  Synthetic Construct
ccataccagacacaaactacagtcaca

SEQ ID NO: 34457 - DNA, 28 bp, Artificial Sequence
  Synthetic Construct
cctgactttctagttcaactcagccttt

SEQ ID NO: 34458 - DNA, 22 bp, Artificial Sequence
  Synthetic Construct
gttgatgctctggctactgcta

SEQ ID NO: 34459 - DNA, 24 bp, Artificial Sequence
  Synthetic Construct
caagggctattcaggactcacaaa

SEQ ID NO: 34460 - DNA, 25 bp, Artificial Sequence
  Synthetic Construct
cactgcataccagcaaatgagttgt

SEQ ID NO: 34461 - DNA, 20 bp, Artificial Sequence
  Synthetic Construct
actgcatggcagagcagctt

SEQ ID NO: 34462 - DNA, 21 bp, Artificial Sequence
  Synthetic Construct
gcagagctcctcaaagggaaa

SEQ ID NO: 34463 - DNA, 25 bp, Artificial Sequence
  Synthetic Construct
ccaccactaccatcatcactatgaa

SEQ ID NO: 34464 - DNA, 22 bp, Artificial Sequence
  Synthetic Construct
gtgagtgaatgggtgggaggta

SEQ ID NO: 34465 - DNA, 25 bp, Artificial Sequence
  Synthetic Construct
catgtgctctagcaagacaatcaaa

SEQ ID NO: 34466 - DNA, 24 bp, Artificial Sequence
  Synthetic Construct
ggagaccacaatgcacaggtctac

SEQ ID NO: 34467 - DNA, 22 bp, Artificial Sequence
  Synthetic Construct
agctctgtaggagggcaaggat

SEQ ID NO: 34468 - DNA, 20 bp, Artificial Sequence
  Synthetic Construct
tccatggctctggctgctat

SEQ ID NO: 34469 - DNA, 22 bp, Artificial Sequence
  Synthetic Construct
ccgtgactagtgcttcgtgctt

SEQ ID NO: 34470 - DNA, 22 bp, Artificial Sequence
  Synthetic Construct
ggaccaatggctggaagaccaa

SEQ ID NO: 34471 - DNA, 24 bp, Artificial Sequence
  Synthetic Construct
cagaagtgtggtggggttacttac

SEQ ID NO: 34472 - DNA, 21 bp, Artificial Sequence
  Synthetic Construct
ggctgttgcagaagcatcact

SEQ ID NO: 34473 - DNA, 21 bp, Artificial Sequence
  Synthetic Construct
ccaaacctgctcctccaccat

SEQ ID NO: 34474 - DNA, 20 bp, Artificial Sequence
  Synthetic Construct
gcccaggtctcgtctccatt

SEQ ID NO: 34475 - DNA, 21 bp, Artificial Sequence
  Synthetic Construct
tgagccttgcagtggggtaac

SEQ ID NO: 34476 - DNA, 30 bp, Artificial Sequence; identical to SEQ ID NO: 3250
  Synthetic Construct

SEQ ID NO: 34477 - DNA, 22 bp, Artificial Sequence
  Synthetic Construct
ccacagtgaagcctggagaaca

SEQ ID NO: 34478 - DNA, 20 bp, Artificial Sequence
  Synthetic Construct
ggacatgggcgaggcaattt

SEQ ID NO: 34479 - DNA, 23 bp, Artificial Sequence
  Synthetic Construct
atcccagggaggagaggtgacat

SEQ ID NO: 34480 - DNA, 22 bp, Artificial Sequence
  Synthetic Construct
cgctggcccttctagtgaatgt

SEQ ID NO: 34481 - DNA, 24 bp, Artificial Sequence
  Synthetic Construct
ctgcaattccccaacaatctctgt

SEQ ID NO: 34482 - DNA, 20 bp, Artificial Sequence
  Synthetic Construct
ggctgtcctccctgcctaaa

SEQ ID NO: 34483 - DNA, 21 bp, Artificial Sequence
  Synthetic Construct
gctgtggggtttgagggctat

SEQ ID NO: 34484 - DNA, 23 bp, Artificial Sequence
  Synthetic Construct
ccctgagagtggtagctactgaa

SEQ ID NO: 34485 - DNA, 25 bp, Artificial Sequence
  Synthetic Construct
gccagatcaaatcattccaggtgaa

SEQ ID NO: 34486 - DNA, 24 bp, Artificial Sequence
  Synthetic Construct
cacagaagggcagataaagcaaaa

SEQ ID NO: 34487 - DNA, 23 bp, Artificial Sequence
  Synthetic Construct
gccatgtggatttccaggtcact

SEQ ID NO: 34488 - DNA, 24 bp, Artificial Sequence
  Synthetic Construct
cgctgtagctgaagcactgtccta

SEQ ID NO: 34489 - DNA, 22 bp, Artificial Sequence
  Synthetic Construct
ctgctgattcaggaccacagaa

SEQ ID NO: 34490 - DNA, 22 bp, Artificial Sequence
  Synthetic Construct
agcacagggcaacagaagtaac

SEQ ID NO: 34491 - DNA, 25 bp, Artificial Sequence
  Synthetic Construct
gggcccaacatctagttctgctaca

SEQ ID NO: 34492 - DNA, 25 bp, Artificial Sequence
  Synthetic Construct
gagaaagcaggtactgaccttttca

SEQ ID NO: 34493 - DNA, 23 bp, Artificial Sequence
  Synthetic Construct
ccagtctccatctggaggaccaa

SEQ ID NO: 34494 - DNA, 28 bp, Artificial Sequence
  Synthetic Construct
ggcaagcccatcatagattttagtgaca

SEQ ID NO: 34495 - DNA, 22 bp, Artificial Sequence
  Synthetic Construct
ccccacctctttctgggatttg

SEQ ID NO: 34496 - DNA, 22 bp, Artificial Sequence
  Synthetic Construct
agtggctgaacagaccgtctac

SEQ ID NO: 34497 - DNA, 24 bp, Artificial Sequence
  Synthetic Construct
cagcctagtgagggtgtaagacta

SEQ ID NO: 34498 - DNA, 19 bp, Artificial Sequence
  Synthetic Construct
gggtgtggggcgtagtgaa

SEQ ID NO: 34499 - DNA, 19 bp, Artificial Sequence
  Synthetic Construct
gcagaggcaccaccacact

SEQ ID NO: 34500 - DNA, 22 bp, Artificial Sequence
  Synthetic Construct
cctgcatacggagaggtcaaag

SEQ ID NO: 34501 - DNA, 22 bp, Artificial Sequence
  Synthetic Construct
gcgccatctttttgaggcatag

SEQ ID NO: 34502 - DNA, 26 bp, Artificial Sequence
  Synthetic Construct
ggaaggttctgacagacaatggaact

SEQ ID NO: 34503 - DNA, 20 bp, Artificial Sequence
  Synthetic Construct
catcttccacgcctgagctt

SEQ ID NO: 34504 - DNA, 21 bp, Artificial Sequence
  Synthetic Construct
gctcatgggcagggttcactt

SEQ ID NO: 34505 - DNA, 20 bp, Artificial Sequence
  Synthetic Construct
gcagaagcactgtccagact

SEQ ID NO: 34506 - DNA, 26 bp, Artificial Sequence
  Synthetic Construct
ccttctatcagtagcaaggagacagt

SEQ ID NO: 34507 - DNA, 20 bp, Artificial Sequence
  Synthetic Construct
agcgggttggactcactgtt

SEQ ID NO: 34508 - DNA, 23 bp, Artificial Sequence
  Synthetic Construct
ggctaactgagccctggtgaatg

SEQ ID NO: 34509 - DNA, 22 bp, Artificial Sequence
  Synthetic Construct
ctggagacgtacatgccagtca

SEQ ID NO: 34510 - DNA, 22 bp, Artificial Sequence
  Synthetic Construct
ccgcccatctctcctgtttgtt

SEQ ID NO: 34511 - DNA, 21 bp, Artificial Sequence
  Synthetic Construct
ggggaacagctggaaaagcat

SEQ ID NO: 34512 - DNA, 21 bp, Artificial Sequence
  Synthetic Construct
agtctggcctgtggtgtctgt

SEQ ID NO: 34513 - DNA, 22 bp, Artificial Sequence
  Synthetic Construct
agggaccccatcacccatttac

SEQ ID NO: 34514 - DNA, 30 bp, Artificial Sequence; identical to SEQ ID NO: 3288
  Synthetic Construct

SEQ ID NO: 34515 - DNA, 24 bp, Artificial Sequence
  Synthetic Construct
tgttttagcagcacgagatgaact

SEQ ID NO: 34516 - DNA, 22 bp, Artificial Sequence
  Synthetic Construct
aggcaaatggcaggagggaatg

SEQ ID NO: 34517 - DNA, 24 bp, Artificial Sequence
  Synthetic Construct
gagattacaggagcatgccacttc

SEQ ID NO: 34518 - DNA, 22 bp, Artificial Sequence
  Synthetic Construct
tgctttcgagaaaagccacact

SEQ ID NO: 34519 - DNA, 23 bp, Artificial Sequence
  Synthetic Construct
gcagcggctatagacagatccaa

SEQ ID NO: 34520 - DNA, 20 bp, Artificial Sequence
  Synthetic Construct
gcactgcctctgcctcaaaa

SEQ ID NO: 34521 - DNA, 23 bp, Artificial Sequence
  Synthetic Construct
taccaccagggctgatccagaga

SEQ ID NO: 34522 - DNA, 22 bp, Artificial Sequence
  Synthetic Construct
gtggtctgcagtcacatcttga

SEQ ID NO: 34523 - DNA, 23 bp, Artificial Sequence
  Synthetic Construct
gtccatcagccagatgtggagtt

SEQ ID NO: 34524 - DNA, 22 bp, Artificial Sequence
  Synthetic Construct
gggtctgtcgcctgacttaaca

SEQ ID NO: 34525 - DNA, 21 bp, Artificial Sequence
  Synthetic Construct
agaggtcagggtgaagcacta

SEQ ID NO: 34526 - DNA, 27 bp, Artificial Sequence
  Synthetic Construct
ggaaaaagtggaggcactgattcattc

SEQ ID NO: 34527 - DNA, 26 bp, Artificial Sequence
  Synthetic Construct
agagaatagtacctcccatgggtaaa

SEQ ID NO: 34528 - DNA, 20 bp, Artificial Sequence
  Synthetic Construct
gcagagccaggcctcaaaac

SEQ ID NO: 34529 - DNA, 19 bp, Artificial Sequence
  Synthetic Construct
tgagtcctgccgcttcaca

SEQ ID NO: 34530 - DNA, 22 bp, Artificial Sequence
  Synthetic Construct
gtgggaagcgggttaggaagat

SEQ ID NO: 34531 - DNA, 22 bp, Artificial Sequence
  Synthetic Construct
ggagccagacttcttggtcctt

SEQ ID NO: 34532 - DNA, 21 bp, Artificial Sequence
  Synthetic Construct
gcgttgtggtgctttcctttc

SEQ ID NO: 34533 - DNA, 25 bp, Artificial Sequence
  Synthetic Construct
aattttcagaggaaagggaggaaca

SEQ ID NO: 34534 - DNA, 21 bp, Artificial Sequence
  Synthetic Construct
gcaccacataggtgacagcaa

SEQ ID NO: 34535 - DNA, 18 bp, Artificial Sequence
  Synthetic Construct
agtgcacgtccgccgtaa

SEQ ID NO: 34536 - DNA, 24 bp, Artificial Sequence
  Synthetic Construct
tcctcaggttgttaggcattttga

SEQ ID NO: 34537 - DNA, 21 bp, Artificial Sequence
  Synthetic Construct
ggcactggggaagacgaagaa

SEQ ID NO: 34538 - DNA, 21 bp, Artificial Sequence
  Synthetic Construct
tcctgcttgcctctggggaat

SEQ ID NO: 34539 - DNA, 20 bp, Artificial Sequence
  Synthetic Construct
accctggtgggatccagaaa

SEQ ID NO: 34540 - DNA, 23 bp, Artificial Sequence
  Synthetic Construct
cgagcccctatccagaaagaaaa

SEQ ID NO: 34541 - DNA, 23 bp, Artificial Sequence
  Synthetic Construct
gctcaaatcaccttcctgcaagt

SEQ ID NO: 34542 - DNA, 27 bp, Artificial Sequence
  Synthetic Construct
ggtacttttacttttgccgtaggtagt

SEQ ID NO: 34543 - DNA, 22 bp, Artificial Sequence
  Synthetic Construct
gggctgttacctcatcctcttg

SEQ ID NO: 34544 - DNA, 22 bp, Artificial Sequence
  Synthetic Construct
catcatgcccaagtagcgttca

SEQ ID NO: 34545 - DNA, 24 bp, Artificial Sequence
  Synthetic Construct
gggatttttgagcccctgaaattg

SEQ ID NO: 34546 - DNA, 20 bp, Artificial Sequence
  Synthetic Construct
acaccggcgacttctccaat

SEQ ID NO: 34547 - DNA, 22 bp, Artificial Sequence
  Synthetic Construct
tggcctcaggcaacactctgta

SEQ ID NO: 34548 - DNA, 28 bp, Artificial Sequence
  Synthetic Construct
ctcaaggctaaagtaactccttggaaag

SEQ ID NO: 34549 - DNA, 20 bp, Artificial Sequence
  Synthetic Construct
agtctgcagagacccgtgta

SEQ ID NO: 34550 - DNA, 22 bp, Artificial Sequence
  Synthetic Construct
tgctgggtaggtgtgtggtaca

SEQ ID NO: 34551 - DNA, 20 bp, Artificial Sequence
  Synthetic Construct
aacacaggcctggctctcaa

SEQ ID NO: 34552 - DNA, 20 bp, Artificial Sequence
  Synthetic Construct
ggaaagggagggaggtgctt

SEQ ID NO: 34553 - DNA, 22 bp, Artificial Sequence
  Synthetic Construct
gctctcctggctctgtgaggat

SEQ ID NO: 34554 - DNA, 22 bp, Artificial Sequence
  Synthetic Construct
acaacctagtgccaggggaagt

SEQ ID NO: 34555 - DNA, 21 bp, Artificial Sequence
  Synthetic Construct
acaagccccacagggtagact

SEQ ID NO: 34556 - DNA, 24 bp, Artificial Sequence
  Synthetic Construct
gaaccagtttcctttctcctggaa

SEQ ID NO: 34557 - DNA, 18 bp, Artificial Sequence
  Synthetic Construct
ggaagccactcgctgcat

SEQ ID NO: 34558 - DNA, 18 bp, Artificial Sequence
  Synthetic Construct
tgggtgcctcggatgctt

SEQ ID NO: 34559 - DNA, 23 bp, Artificial Sequence
  Synthetic Construct
gctcattaatgcacgcagacaca

SEQ ID NO: 34560 - DNA, 28 bp, Artificial Sequence
  Synthetic Construct
ggtggtacagaatacaatggctgtgatg

SEQ ID NO: 34561 - DNA, 22 bp, Artificial Sequence
  Synthetic Construct
tctggtagcaggagggagaaag

SEQ ID NO: 34562 - DNA, 26 bp, Artificial Sequence
  Synthetic Construct
ggatgtgttcatccgtctcttcacta

SEQ ID NO: 34563 - DNA, 20 bp, Artificial Sequence
  Synthetic Construct
agacatgggtccctctgctt

SEQ ID NO: 34564 - DNA, 28 bp, Artificial Sequence
  Synthetic Construct
cctggtacctgatatgatgttagctgta

SEQ ID NO: 34565 - DNA, 21 bp, Artificial Sequence
  Synthetic Construct
ggtccacccatagccctctga

SEQ ID NO: 34566 - DNA, 25 bp, Artificial Sequence
  Synthetic Construct
ggtaggcatttttcgatggcagaga

SEQ ID NO: 34567 - DNA, 20 bp, Artificial Sequence
  Synthetic Construct
agtagaggcagggtcacaca

SEQ ID NO: 34568 - DNA, 23 bp, Artificial Sequence
  Synthetic Construct
actaaggaagcctcttgggttct

SEQ ID NO: 34569 - DNA, 24 bp, Artificial Sequence
  Synthetic Construct
ctcttccctgaagacaaccaactt

SEQ ID NO: 34570 - DNA, 23 bp, Artificial Sequence
  Synthetic Construct
ccttccaggttgatggtcgcatt

SEQ ID NO: 34571 - DNA, 20 bp, Artificial Sequence
  Synthetic Construct
cactgcccagatggcagaag

SEQ ID NO: 34572 - DNA, 22 bp, Artificial Sequence
  Synthetic Construct
cgtggctgcatctgatcctttc

SEQ ID NO: 34573 - DNA, 20 bp, Artificial Sequence
  Synthetic Construct
tgtgagaggccgttgggaaa

SEQ ID NO: 34574 - DNA, 26 bp, Artificial Sequence
  Synthetic Construct
ggaaatgtttgactcatgccctgatg

SEQ ID NO: 34575 - DNA, 20 bp, Artificial Sequence
  Synthetic Construct
agtcagccagatgcccagaa

SEQ ID NO: 34576 - DNA, 20 bp, Artificial Sequence
  Synthetic Construct
agctcaggactgcgttcttc

SEQ ID NO: 34577 - DNA, 24 bp, Artificial Sequence
  Synthetic Construct
ccatgtacccaggagaggtgatga

SEQ ID NO: 34578 - DNA, 20 bp, Artificial Sequence
  Synthetic Construct
tgtgtgctgcagtggagctt

SEQ ID NO: 34579 - DNA, 25 bp, Artificial Sequence
  Synthetic Construct
ggcgtaacattagggtaccttctct

SEQ ID NO: 34580 - DNA, 24 bp, Artificial Sequence
  Synthetic Construct
gggtctgggagagggataacttca

SEQ ID NO: 34581 - DNA, 23 bp, Artificial Sequence
  Synthetic Construct
gtggtaactgcacgaggacaaag

SEQ ID NO: 34582 - DNA, 21 bp, Artificial Sequence
  Synthetic Construct
ggagcctcttggttcctgtgt

SEQ ID NO: 34583 - DNA, 21 bp, Artificial Sequence
  Synthetic Construct
aagacctctcgcaggccgatt

SEQ ID NO: 34584 - DNA, 20 bp, Artificial Sequence
  Synthetic Construct
agtgaaggccctctcctgaa

SEQ ID NO: 34585 - DNA, 24 bp, Artificial Sequence
  Synthetic Construct
cctcgattcagtctggggacattc

SEQ ID NO: 34586 - DNA, 22 bp, Artificial Sequence
  Synthetic Construct
tcactttccacctctcgaggaa

SEQ ID NO: 34587 - DNA, 22 bp, Artificial Sequence
  Synthetic Construct
aggtgaagcagagcaggacttc

SEQ ID NO: 34588 - DNA, 23 bp, Artificial Sequence
  Synthetic Construct
gcctcctcatctcatgggtttca

SEQ ID NO: 34589 - DNA, 21 bp, Artificial Sequence
  Synthetic Construct
aacccctttggtcttgcacat

SEQ ID NO: 34590 - DNA, 26 bp, Artificial Sequence
  Synthetic Construct
gctgctatggtggtatcagggagttc

SEQ ID NO: 34591 - DNA, 22 bp, Artificial Sequence
  Synthetic Construct
gcaggagcaggtttagctgaca

SEQ ID NO: 34592 - DNA, 20 bp, Artificial Sequence
  Synthetic Construct
ctcacacttgggcactgctt

SEQ ID NO: 34593 - DNA, 21 bp, Artificial Sequence
  Synthetic Construct
gctccccagtgatgggctttt

SEQ ID NO: 34594 - DNA, 27 bp, Artificial Sequence
  Synthetic Construct
cctctgtctacacagtgaacagcattg

SEQ ID NO: 34595 - DNA, 21 bp, Artificial Sequence
  Synthetic Construct
agcacccctgagcatgtggat

SEQ ID NO: 34596 - DNA, 21 bp, Artificial Sequence
  Synthetic Construct
cgatgcaggccatgacagaca

SEQ ID NO: 34597 - DNA, 23 bp, Artificial Sequence
  Synthetic Construct
ataatcagcctgcctcaaacaga

SEQ ID NO: 34598 - DNA, 23 bp, Artificial Sequence
  Synthetic Construct
gctgccaagagaaatgggacact

SEQ ID NO: 34599 - DNA, 22 bp, Artificial Sequence
  Synthetic Construct
gccatctcaaactcggccaatg

SEQ ID NO: 34600 - DNA, 22 bp, Artificial Sequence
  Synthetic Construct
gcagcttgcatgctttggaaca

SEQ ID NO: 34601 - DNA, 25 bp, Artificial Sequence
  Synthetic Construct
gtgaatggaaggtgcatgtaagaag

SEQ ID NO: 34602 - DNA, 25 bp, Artificial Sequence
  Synthetic Construct
ggggagaaacataatgctgggtctt

SEQ ID NO: 34603 - DNA, 22 bp, Artificial Sequence
  Synthetic Construct
gacagaccaagcctggagatca

SEQ ID NO: 34604 - DNA, 26 bp, Artificial Sequence
  Synthetic Construct
gcttcactaacaccagggtaggtatc

SEQ ID NO: 34605 - DNA, 22 bp, Artificial Sequence
  Synthetic Construct
gctggaactgggatttcagcaa

SEQ ID NO: 34606 - DNA, 24 bp, Artificial Sequence
  Synthetic Construct
gtccataacaggaccttagagcaa

SEQ ID NO: 34607 - DNA, 22 bp, Artificial Sequence
  Synthetic Construct
gctcttgggagtaggtggaaac

SEQ ID NO: 34608 - DNA, 24 bp, Artificial Sequence
  Synthetic Construct
ggttttgggacctagaagcagtca

SEQ ID NO: 34609 - DNA, 23 bp, Artificial Sequence
  Synthetic Construct
gggatagcaggtctctgttccaa

SEQ ID NO: 34610 - DNA, 23 bp, Artificial Sequence
  Synthetic Construct
ctcttctggagctctacccaact

SEQ ID NO: 34611 - DNA, 23 bp, Artificial Sequence
  Synthetic Construct
ccctttttccctgaagagctgaa

SEQ ID NO: 34612 - DNA, 24 bp, Artificial Sequence
  Synthetic Construct
ggactggtgaggaaggtgtaggaa

SEQ ID NO: 34613 - DNA, 22 bp, Artificial Sequence
  Synthetic Construct
gcaaaactccgggatcctcaac

SEQ ID NO: 34614 - DNA, 21 bp, Artificial Sequence
  Synthetic Construct
ttccctcccaggcaaggagtt

SEQ ID NO: 34615 - DNA, 18 bp, Artificial Sequence
  Synthetic Construct
tgcccaggtggagggttt

SEQ ID NO: 34616 - DNA, 22 bp, Artificial Sequence
  Synthetic Construct
aatcagccccaaagcaaagaac

SEQ ID NO: 34617 - DNA, 21 bp, Artificial Sequence
  Synthetic Construct
ccaaagtcgggagaagccaaa

SEQ ID NO: 34618 - DNA, 20 bp, Artificial Sequence
  Synthetic Construct
cctcaacacagcagccaaga

SEQ ID NO: 34619 - DNA, 23 bp, Artificial Sequence
  Synthetic Construct
cccacttcggtacaagtcagaca

SEQ ID NO: 34620 - DNA, 21 bp, Artificial Sequence
  Synthetic Construct
gccagtgtcactcccaagtca

SEQ ID NO: 34621 - DNA, 20 bp, Artificial Sequence
  Synthetic Construct
gggtagacagcagccgtaca

SEQ ID NO: 34622 - DNA, 21 bp, Artificial Sequence
  Synthetic Construct
cccctcctctgcagggttcta

SEQ ID NO: 34623 - DNA, 22 bp, Artificial Sequence
  Synthetic Construct
agggtcagttgggagtagaaca

SEQ ID NO: 34624 - DNA, 24 bp, Artificial Sequence
  Synthetic Construct
tgttcccacctctttatcctcctt

SEQ ID NO: 34625 - DNA, 18 bp, Artificial Sequence
  Synthetic Construct
tcagcgggctgtgtgtct

SEQ ID NO: 34626 - DNA, 19 bp, Artificial Sequence
  Synthetic Construct
ggagggctgcagctgaact

SEQ ID NO: 34627 - DNA, 19 bp, Artificial Sequence
  Synthetic Construct
acagccacagggcacttct

SEQ ID NO: 34628 - DNA, 22 bp, Artificial Sequence
  Synthetic Construct
gcagaagcttaggacggcattc

SEQ ID NO: 34629 - DNA, 26 bp, Artificial Sequence
  Synthetic Construct
gcctttccacctttgtctgaggagat

SEQ ID NO: 34630 - DNA, 22 bp, Artificial Sequence
  Synthetic Construct
gggcaggaatgcatgggcataa

SEQ ID NO: 34631 - DNA, 25 bp, Artificial Sequence
  Synthetic Construct
aaaactgcaaggagcctattgttac

SEQ ID NO: 34632 - DNA, 20 bp, Artificial Sequence
  Synthetic Construct
gcaaacagctgggcaagaga

SEQ ID NO: 34633 - DNA, 20 bp, Artificial Sequence
  Synthetic Construct
tccaggagcaggaggaggta

SEQ ID NO: 34634 - DNA, 21 bp, Artificial Sequence
  Synthetic Construct
ttgaatggccccagtgatgtt

SEQ ID NO: 34635 - DNA, 23 bp, Artificial Sequence
  Synthetic Construct
gaggctcagaaagatgcactgat

SEQ ID NO: 34636 - DNA, 21 bp, Artificial Sequence
  Synthetic Construct
aaggtgtggggagagcagtca

SEQ ID NO: 34637 - DNA, 20 bp, Artificial Sequence
  Synthetic Construct
gccttcgtggctagggttgt

SEQ ID NO: 34638 - DNA, 22 bp, Artificial Sequence
  Synthetic Construct
ggacggatgcaccaaacgtgat

SEQ ID NO: 34639 - DNA, 25 bp, Artificial Sequence
  Synthetic Construct
ccaatcagccatttggtgaatagtt

SEQ ID NO: 34640 - DNA, 22 bp, Artificial Sequence
  Synthetic Construct
cacaaaagcgcctctggtgaag

SEQ ID NO: 34641 - DNA, 19 bp, Artificial Sequence
  Synthetic Construct
taacgctgtggcggactca

SEQ ID NO: 34642 - DNA, 25 bp, Artificial Sequence
  Synthetic Construct
tttctacctgtgtcatttggacctt

SEQ ID NO: 34643 - DNA, 23 bp, Artificial Sequence
  Synthetic Construct
accatgacacttttcctgaccat

SEQ ID NO: 34644 - DNA, 22 bp, Artificial Sequence
  Synthetic Construct
gcatctccactccaagttcctt

SEQ ID NO: 34645 - DNA, 24 bp, Artificial Sequence
  Synthetic Construct
gttagaaaacctctgtgccagtga

SEQ ID NO: 34646 - DNA, 25 bp, Artificial Sequence
  Synthetic Construct
acgtatattttggtggggttgatgt

SEQ ID NO: 34647 - DNA, 20 bp, Artificial Sequence
  Synthetic Construct
cccggagtgttccccagttt

SEQ ID NO: 34648 - DNA, 21 bp, Artificial Sequence
  Synthetic Construct
aggctagtcccaggacaggaa

SEQ ID NO: 34649 - DNA, 21 bp, Artificial Sequence
  Synthetic Construct
agtgctaccggctcctgaact

SEQ ID NO: 34650 - DNA, 22 bp, Artificial Sequence
  Synthetic Construct
gggccactgtgattgcagactt

SEQ ID NO: 34651 - DNA, 20 bp, Artificial Sequence
  Synthetic Construct
cccaggcagctggtcctcta

SEQ ID NO: 34652 - DNA, 20 bp, Artificial Sequence
  Synthetic Construct
aactgatggcccctccaagt

SEQ ID NO: 34653 - DNA, 18 bp, Artificial Sequence
  Synthetic Construct
tgcccaccagtgccatgt

SEQ ID NO: 34654 - DNA, 19 bp, Artificial Sequence
  Synthetic Construct
aggatggcgagggctggaa

SEQ ID NO: 34655 - DNA, 23 bp, Artificial Sequence
  Synthetic Construct
ttggttcccagctactacagaga

SEQ ID NO: 34656 - DNA, 24 bp, Artificial Sequence
  Synthetic Construct
ggagcctggttttccatgccattc

SEQ ID NO: 34657 - DNA, 26 bp, Artificial Sequence
  Synthetic Construct
cagaagaaaacaatgcaggggttatg

SEQ ID NO: 34658 - DNA, 28 bp, Artificial Sequence
  Synthetic Construct
ccagctaccaaactcatttacagacaga

SEQ ID NO: 34659 - DNA, 20 bp, Artificial Sequence
  Synthetic Construct
tgacttctggtgccctggtt

SEQ ID NO: 34660 - DNA, 21 bp, Artificial Sequence
  Synthetic Construct
tgcaggggacccaacctttca

SEQ ID NO: 34661 - DNA, 21 bp, Artificial Sequence
  Synthetic Construct
tgcctaagcagaggcagtttg

SEQ ID NO: 34662 - DNA, 25 bp, Artificial Sequence
  Synthetic Construct
tccaatgtcagttggggtaactaaa

SEQ ID NO: 34663 - DNA, 27 bp, Artificial Sequence
  Synthetic Construct
gtccatttccacttattccagcatttg

SEQ ID NO: 34664 - DNA, 22 bp, Artificial Sequence
  Synthetic Construct
ccattgagagcaagggcaggta

SEQ ID NO: 34665 - DNA, 25 bp, Artificial Sequence
  Synthetic Construct
tgacatgtgtgtttatgagggagaa

SEQ ID NO: 34666 - DNA, 19 bp, Artificial Sequence
  Synthetic Construct
ttcggtgggagggctgtca

SEQ ID NO: 34667 - DNA, 26 bp, Artificial Sequence
  Synthetic Construct
cctgattccttgctcctcatccatag

SEQ ID NO: 34668 - DNA, 27 bp, Artificial Sequence
  Synthetic Construct
tgctgcttattgtctagaagctgtatc

SEQ ID NO: 34669 - DNA, 21 bp, Artificial Sequence
  Synthetic Construct
acatccctgcctcccacaagt

SEQ ID NO: 34670 - DNA, 20 bp, Artificial Sequence
  Synthetic Construct
tgctcctgcacggtcacaat

SEQ ID NO: 34671 - DNA, 23 bp, Artificial Sequence
  Synthetic Construct
gtgatcatttgcccttggctaca

SEQ ID NO: 34672 - DNA, 27 bp, Artificial Sequence
  Synthetic Construct
ctgacaatgattatggattggggtgtt

SEQ ID NO: 34673 - DNA, 25 bp, Artificial Sequence
  Synthetic Construct
ccctagaggttcatgggtacagaca

SEQ ID NO: 34674 - DNA, 19 bp, Artificial Sequence
  Synthetic Construct
acaatggagccggcactga

SEQ ID NO: 34675 - DNA, 27 bp, Artificial Sequence
  Synthetic Construct
gcttgtgggtttgactgaagagacttt

SEQ ID NO: 34676 - DNA, 20 bp, Artificial Sequence
  Synthetic Construct
ggccctggaagtcaggaaag

SEQ ID NO: 34677 - DNA, 21 bp, Artificial Sequence
  Synthetic Construct
ccagccttggttgtcctggtt

SEQ ID NO: 34678 - DNA, 27 bp, Artificial Sequence
  Synthetic Construct
ggaaggtaatacagcctgatgggagaa

SEQ ID NO: 34679 - DNA, 21 bp, Artificial Sequence
  Synthetic Construct
gcaagcagtgtctggcaaatc

SEQ ID NO: 34680 - DNA, 22 bp, Artificial Sequence
  Synthetic Construct
ccaactgcttcctgctgactgt

SEQ ID NO: 34681 - DNA, 22 bp, Artificial Sequence
  Synthetic Construct
ggtactaatgccgctgatgctt

SEQ ID NO: 34682 - DNA, 24 bp, Artificial Sequence
  Synthetic Construct
gtggtttaagtgcggactgtgttg

SEQ ID NO: 34683 - DNA, 21 bp, Artificial Sequence
  Synthetic Construct
tgagggaggtcggcacctaaa

SEQ ID NO: 34684 - DNA, 19 bp, Artificial Sequence
  Synthetic Construct
ggagcaggtccccagtgaa

SEQ ID NO: 34685 - DNA, 20 bp, Artificial Sequence
  Synthetic Construct
agtgctgagggtggcagaca

SEQ ID NO: 34686 - DNA, 25 bp, Artificial Sequence
  Synthetic Construct
gttctcaaatcaatccatggcaact

SEQ ID NO: 34687 - DNA, 23 bp, Artificial Sequence
  Synthetic Construct
ccttctccagcttcccaggatac

SEQ ID NO: 34688 - DNA, 19 bp, Artificial Sequence
  Synthetic Construct
aggcgatggcacgctgtct

SEQ ID NO: 34689 - DNA, 23 bp, Artificial Sequence
  Synthetic Construct
caacatccaacagagccgatttt

SEQ ID NO: 34690 - DNA, 20 bp, Artificial Sequence
  Synthetic Construct
acacaaggggcacccagaaa

SEQ ID NO: 34691 - DNA, 27 bp, Artificial Sequence
  Synthetic Construct
gcttcaggggagataaggaaatcaaga

SEQ ID NO: 34692 - DNA, 25 bp, Artificial Sequence
  Synthetic Construct
gcaatcacccaagaccaaacccaat

SEQ ID NO: 34693 - DNA, 19 bp, Artificial Sequence
  Synthetic Construct
caaggggctgccttcttga

SEQ ID NO: 34694 - DNA, 20 bp, Artificial Sequence
  Synthetic Construct
tgccccatttccctcagagt

SEQ ID NO: 34695 - DNA, 22 bp, Artificial Sequence
  Synthetic Construct
tttgtggagaaggcaagtgtca

SEQ ID NO: 34696 - DNA, 20 bp, Artificial Sequence
  Synthetic Construct
gcctgtgccatcagccaact

SEQ ID NO: 34697 - DNA, 22 bp, Artificial Sequence
  Synthetic Construct
aaccagatacacctgcatgctt

SEQ ID NO: 34698 - DNA, 19 bp, Artificial Sequence
  Synthetic Construct
atgccggggaaagccagaa

SEQ ID NO: 34699 - DNA, 22 bp, Artificial Sequence
  Synthetic Construct
ccatctgtgctggccaatccta

SEQ ID NO: 34700 - DNA, 21 bp, Artificial Sequence
  Synthetic Construct
ttcccaccatccgagactttg

SEQ ID NO: 34701 - DNA, 18 bp, Artificial Sequence
  Synthetic Construct
tgtgccctgggacactga

SEQ ID NO: 34702 - DNA, 21 bp, Artificial Sequence
  Synthetic Construct
gctgggtctggacccttctaa

SEQ ID NO: 34703 - DNA, 24 bp, Artificial Sequence
  Synthetic Construct
ggtgtgctggaccgagattctaac

SEQ ID NO: 34704 - DNA, 20 bp, Artificial Sequence
  Synthetic Construct
tgcacgcactctcccttatg

SEQ ID NO: 34705 - DNA, 22 bp, Artificial Sequence
  Synthetic Construct
ggaatgctgccacttggtgtag

SEQ ID NO: 34706 - DNA, 20 bp, Artificial Sequence
  Synthetic Construct
acacccacccatctctcctt

SEQ ID NO: 34707 - DNA, 19 bp, Artificial Sequence
  Synthetic Construct
tgccccaggccagaagcat

SEQ ID NO: 34708 - DNA, 19 bp, Artificial Sequence
  Synthetic Construct
ccgacggcagaacggaaac

SEQ ID NO: 34709 - DNA, 18 bp, Artificial Sequence
  Synthetic Construct
agggcaccagaggtgaca

SEQ ID NO: 34710 - DNA, 20 bp, Artificial Sequence
  Synthetic Construct
tggcaggtgctgctgtcaga

SEQ ID NO: 34711 - DNA, 20 bp, Artificial Sequence
  Synthetic Construct
tgttccctgcggtaggatgt

SEQ ID NO: 34712 - DNA, 22 bp, Artificial Sequence
  Synthetic Construct
gcccttgtgctttggggttcaa

SEQ ID NO: 34713 - DNA, 23 bp, Artificial Sequence
  Synthetic Construct
tccttactgctcagcatggatct

SEQ ID NO: 34714 - DNA, 26 bp, Artificial Sequence
  Synthetic Construct
ggaaacctcctatagtacggccagaa

SEQ ID NO: 34715 - DNA, 21 bp, Artificial Sequence
  Synthetic Construct
caccagccatggacaacaagt

SEQ ID NO: 34716 - DNA, 22 bp, Artificial Sequence
  Synthetic Construct
gcctcctggtattcctgtgcta

SEQ ID NO: 34717 - DNA, 23 bp, Artificial Sequence
  Synthetic Construct
ccgggaaatcagaggtgggtaac

SEQ ID NO: 34718 - DNA, 22 bp, Artificial Sequence
  Synthetic Construct
gtccatcaggaagcaagcacat

SEQ ID NO: 34719 - DNA, 22 bp, Artificial Sequence
  Synthetic Construct
ccagcaagaggaaactgcgtaa

SEQ ID NO: 34720 - DNA, 25 bp, Artificial Sequence
  Synthetic Construct
gggcagtagaaggtatcagcagtgt

SEQ ID NO: 34721 - DNA, 22 bp, Artificial Sequence
  Synthetic Construct
gtgccttacttcgggagctttc

SEQ ID NO: 34722 - DNA, 18 bp, Artificial Sequence
  Synthetic Construct
tgctgcgggtgaggttca

SEQ ID NO: 34723 - DNA, 21 bp, Artificial Sequence
  Synthetic Construct
cccaatccgagctgcagtcat

SEQ ID NO: 34724 - DNA, 23 bp, Artificial Sequence
  Synthetic Construct
tcctccatctaactcctgctcat

SEQ ID NO: 34725 - DNA, 24 bp, Artificial Sequence
  Synthetic Construct
ctgccttgataactctgggcattg

SEQ ID NO: 34726 - DNA, 19 bp, Artificial Sequence
  Synthetic Construct
ctggggtacccagggatgt

SEQ ID NO: 34727 - DNA, 20 bp, Artificial Sequence
  Synthetic Construct
tgggccagggctgtaatcta

SEQ ID NO: 34728 - DNA, 20 bp, Artificial Sequence
  Synthetic Construct
accggccgaggggtctttga

SEQ ID NO: 34729 - DNA, 21 bp, Artificial Sequence
  Synthetic Construct
tcccttccccacctctctttc

SEQ ID NO: 34730 - DNA, 20 bp, Artificial Sequence
  Synthetic Construct
ccgaaagctctgccaggaaa

SEQ ID NO: 34731 - DNA, 24 bp, Artificial Sequence
  Synthetic Construct
gtgccaatttttgtggggctgata

SEQ ID NO: 34732 - DNA, 21 bp, Artificial Sequence
  Synthetic Construct
cctctccaccaagcacagcat

SEQ ID NO: 34733 - DNA, 22 bp, Artificial Sequence
  Synthetic Construct
ctgccactgtccatccacatct

SEQ ID NO: 34734 - DNA, 20 bp, Artificial Sequence
  Synthetic Construct
tgcaaagtgcatggcacaga

SEQ ID NO: 34735 - DNA, 19 bp, Artificial Sequence
  Synthetic Construct
ggtggcgctgtctctccat

SEQ ID NO: 34736 - DNA, 22 bp, Artificial Sequence
  Synthetic Construct
tcctggcatcaagactgtgaac

SEQ ID NO: 34737 - DNA, 26 bp, Artificial Sequence
  Synthetic Construct
gtctttgtttacctccagggttccta

SEQ ID NO: 34738 - DNA, 24 bp, Artificial Sequence
  Synthetic Construct
ccatctctgcattcccaaatggat

SEQ ID NO: 34739 - DNA, 24 bp, Artificial Sequence
  Synthetic Construct
ccctctgttttcagctccactttc

SEQ ID NO: 34740 - DNA, 23 bp, Artificial Sequence
  Synthetic Construct
cagacttcacccactttgctctt

SEQ ID NO: 34741 - DNA, 20 bp, Artificial Sequence
  Synthetic Construct
tgggctgagcggctttctta

SEQ ID NO: 34742 - DNA, 24 bp, Artificial Sequence
  Synthetic Construct
gggatagcccttgtggctactttc

SEQ ID NO: 34743 - DNA, 27 bp, Artificial Sequence
  Synthetic Construct
tcccattggaaagtatggactacaaag

SEQ ID NO: 34744 - DNA, 24 bp, Artificial Sequence
  Synthetic Construct
gttcaggagtaaggaatggaccaa

SEQ ID NO: 34745 - DNA, 20 bp, Artificial Sequence
  Synthetic Construct
acttggcaggaagggtggat

SEQ ID NO: 34746 - DNA, 18 bp, Artificial Sequence
  Synthetic Construct
tccacccctgccccaaat

SEQ ID NO: 34747 - DNA, 22 bp, Artificial Sequence
  Synthetic Construct
ggcagacgggattcagttgcta

SEQ ID NO: 34748 - DNA, 18 bp, Artificial Sequence
  Synthetic Construct
accatgctggcccacagt

SEQ ID NO: 34749 - DNA, 21 bp, Artificial Sequence
  Synthetic Construct
gggactttcccaggccatgta

SEQ ID NO: 34750 - DNA, 26 bp, Artificial Sequence
  Synthetic Construct
gtcttgtgctgaatgctgaatggttt

SEQ ID NO: 34751 - DNA, 19 bp, Artificial Sequence
  Synthetic Construct
cctggctccatgggtcact

SEQ ID NO: 34752 - DNA, 19 bp, Artificial Sequence
  Synthetic Construct
tctggggtgccaccagcaa

SEQ ID NO: 34753 - DNA, 22 bp, Artificial Sequence
  Synthetic Construct
gcctcttcatacctgcagaact

SEQ ID NO: 34754 - DNA, 22 bp, Artificial Sequence
  Synthetic Construct
gcaggtggagtctgaagtgtca

SEQ ID NO: 34755 - DNA, 26 bp, Artificial Sequence
  Synthetic Construct
gtcctcattatccactccttccctta

SEQ ID NO: 34756 - DNA, 21 bp, Artificial Sequence
  Synthetic Construct
aggctgcagaacagcaaagat

SEQ ID NO: 34757 - DNA, 22 bp, Artificial Sequence
  Synthetic Construct
ctggtgggccttatggacaaga

SEQ ID NO: 34758 - DNA, 24 bp, Artificial Sequence
  Synthetic Construct
ctggggccagagtctgattcttag

SEQ ID NO: 34759 - DNA, 22 bp, Artificial Sequence
  Synthetic Construct
gcactggagatgaggctgcttt

SEQ ID NO: 34760 - DNA, 20 bp, Artificial Sequence
  Synthetic Construct
tttctgccccacctgcacaa

SEQ ID NO: 34761 - DNA, 24 bp, Artificial Sequence
  Synthetic Construct
ccaaaactatctcaggtgcaggaa

SEQ ID NO: 34762 - DNA, 22 bp, Artificial Sequence
  Synthetic Construct
cctctggcaaagcacccattca

SEQ ID NO: 34763 - DNA, 20 bp, Artificial Sequence
  Synthetic Construct
agagccaagaggctgcaaca

SEQ ID NO: 34764 - DNA, 22 bp, Artificial Sequence
  Synthetic Construct
gcagtgagccagtagccttttg

SEQ ID NO: 34765 - DNA, 23 bp, Artificial Sequence
  Synthetic Construct
gctccaaggtactagtgctgcat

SEQ ID NO: 34766 - DNA, 22 bp, Artificial Sequence
  Synthetic Construct
ggccaacctctgtaccttcagt

SEQ ID NO: 34767 - DNA, 23 bp, Artificial Sequence
  Synthetic Construct
cacttctcagtctctcccctttg

SEQ ID NO: 34768 - DNA, 22 bp, Artificial Sequence
  Synthetic Construct
ctcctggtttgcctggtactct

SEQ ID NO: 34769 - DNA, 20 bp, Artificial Sequence
  Synthetic Construct
agggagggaccagtcaactt

SEQ ID NO: 34770 - DNA, 29 bp, Artificial Sequence
  Synthetic Construct
gccctacaggtttacatgcaaagatattc

SEQ ID NO: 34771 - DNA, 21 bp, Artificial Sequence
  Synthetic Construct
gctgtccatgcagagctaagt

SEQ ID NO: 34772 - DNA, 22 bp, Artificial Sequence
  Synthetic Construct
gaatgaactggcaggcatctgt

SEQ ID NO: 34773 - DNA, 22 bp, Artificial Sequence
  Synthetic Construct
ggctaagggaatgccgacataa

SEQ ID NO: 34774 - DNA, 20 bp, Artificial Sequence
  Synthetic Construct
gccagaagggaatcgccaat

SEQ ID NO: 34775 - DNA, 20 bp, Artificial Sequence
  Synthetic Construct
ttccatccccggagcaactt

SEQ ID NO: 34776 - DNA, 21 bp, Artificial Sequence
  Synthetic Construct
ttgaaggaagtggcagccttt

SEQ ID NO: 34777 - DNA, 20 bp, Artificial Sequence
  Synthetic Construct
gccttccctggagctcgtta

SEQ ID NO: 34778 - DNA, 26 bp, Artificial Sequence
  Synthetic Construct
ctgaaatggcagcctttatgttcatc

SEQ ID NO: 34779 - DNA, 20 bp, Artificial Sequence
  Synthetic Construct
ttcctcggagtgctgctttg

SEQ ID NO: 34780 - DNA, 20 bp, Artificial Sequence
  Synthetic Construct
tggagctggcaggagtcagt

SEQ ID NO: 34781 - DNA, 20 bp, Artificial Sequence
  Synthetic Construct
gggctgtgaggtttgtgtca

SEQ ID NO: 34782 - DNA, 22 bp, Artificial Sequence
  Synthetic Construct
gctcagggcttgcacattcctt

SEQ ID NO: 34783 - DNA, 22 bp, Artificial Sequence
  Synthetic Construct
tgccctaacttctcctgcattg

SEQ ID NO: 34784 - DNA, 21 bp, Artificial Sequence
  Synthetic Construct
accaggccttccttctagtca

SEQ ID NO: 34785 - DNA, 20 bp, Artificial Sequence
  Synthetic Construct
gggtgagccgaatgttcact

SEQ ID NO: 34786 - DNA, 22 bp, Artificial Sequence
  Synthetic Construct
cccagccagagaggtatcaact

SEQ ID NO: 34787 - DNA, 23 bp, Artificial Sequence
  Synthetic Construct
gctactttgcagctaccactgaa

SEQ ID NO: 34788 - DNA, 26 bp, Artificial Sequence
  Synthetic Construct
ctgaagtatcatctcttccccggatt

SEQ ID NO: 34789 - DNA, 22 bp, Artificial Sequence
  Synthetic Construct
cagaggggtaggatgcatgaga

SEQ ID NO: 34790 - DNA, 26 bp, Artificial Sequence
  Synthetic Construct
ctgatgctagatcctccttctacttg

SEQ ID NO: 34791 - DNA, 20 bp, Artificial Sequence
  Synthetic Construct
ggcaataggagcctgcagat

SEQ ID NO: 34792 - DNA, 20 bp, Artificial Sequence
  Synthetic Construct
gggctgttgggccaagattt

SEQ ID NO: 34793 - DNA, 27 bp, Artificial Sequence
  Synthetic Construct
cccaactatttttgggttaggaagaac

SEQ ID NO: 34794 - DNA, 22 bp, Artificial Sequence
  Synthetic Construct
gggtgacacctgaggttcttga

SEQ ID NO: 34795 - DNA, 22 bp, Artificial Sequence
  Synthetic Construct
cccaaaatgcctcctgggaaac

SEQ ID NO: 34796 - DNA, 25 bp, Artificial Sequence
  Synthetic Construct
ggaacatctcatggtcacgtatttg

SEQ ID NO: 34797 - DNA, 25 bp, Artificial Sequence
  Synthetic Construct
ggtctagggtctcaatttggtcagt

SEQ ID NO: 34798 - DNA, 24 bp, Artificial Sequence
  Synthetic Construct
ccctttggatgactcttcgcacat

SEQ ID NO: 34799 - DNA, 20 bp, Artificial Sequence
  Synthetic Construct
ccactgccaccactgacaaa

SEQ ID NO: 34800 - DNA, 23 bp, Artificial Sequence
  Synthetic Construct
gagtggtttcccatcagggatga

SEQ ID NO: 34801 - DNA, 21 bp, Artificial Sequence
  Synthetic Construct
ggcaaaactgcaacactgtga

SEQ ID NO: 34802 - DNA, 24 bp, Artificial Sequence
  Synthetic Construct
tgcaggtttctcacataactcctt

SEQ ID NO: 34803 - DNA, 24 bp, Artificial Sequence
  Synthetic Construct
ttctctccagcagcactctttatt

SEQ ID NO: 34804 - DNA, 20 bp, Artificial Sequence
  Synthetic Construct
ctgtggcccatgaagcatct

SEQ ID NO: 34805 - DNA, 21 bp, Artificial Sequence
  Synthetic Construct
tgtctgcttcctagcgtcttc

SEQ ID NO: 34806 - DNA, 27 bp, Artificial Sequence
  Synthetic Construct
cacacatttcaggagcttgatctcatc

SEQ ID NO: 34807 - DNA, 26 bp, Artificial Sequence
  Synthetic Construct
ggaaccatgttcctttccaggttgtt

SEQ ID NO: 34808 - DNA, 23 bp, Artificial Sequence
  Synthetic Construct
tcatcatcccagagacacagcta

SEQ ID NO: 34809 - DNA, 24 bp, Artificial Sequence
  Synthetic Construct
ccttgtgctgctaaccatgagact

SEQ ID NO: 34810 - DNA, 24 bp, Artificial Sequence
  Synthetic Construct
ggaccctagtgattctcccatcat

SEQ ID NO: 34811 - DNA, 22 bp, Artificial Sequence
  Synthetic Construct
cacacttttcggtggtgccttt

SEQ ID NO: 34812 - DNA, 22 bp, Artificial Sequence
  Synthetic Construct
aggagccaagaacaaggagaag

SEQ ID NO: 34813 - DNA, 23 bp, Artificial Sequence
  Synthetic Construct
tggccataacagagtaggtgtga

SEQ ID NO: 34814 - DNA, 20 bp, Artificial Sequence
  Synthetic Construct
tagccccacgtgtcttccta

SEQ ID NO: 34815 - DNA, 24 bp, Artificial Sequence
  Synthetic Construct
acttgttcacttgctaggggatac

SEQ ID NO: 34816 - DNA, 22 bp, Artificial Sequence
  Synthetic Construct
cagagagaaggaggcccaaaga

SEQ ID NO: 34817 - DNA, 22 bp, Artificial Sequence
  Synthetic Construct
tgtcagtaacggtggagaccta

SEQ ID NO: 34818 - DNA, 24 bp, Artificial Sequence
  Synthetic Construct
gccttttaattagccttgcagctt

SEQ ID NO: 34819 - DNA, 20 bp, Artificial Sequence
  Synthetic Construct
agtgggagcctcgtaagcat

SEQ ID NO: 34820 - DNA, 24 bp, Artificial Sequence
  Synthetic Construct
ggaataggtaggtgcaagcagttg

SEQ ID NO: 34821 - DNA, 25 bp, Artificial Sequence
  Synthetic Construct
atccacaatttccctaggctagaag

SEQ ID NO: 34822 - DNA, 25 bp, Artificial Sequence
  Synthetic Construct
gcctagggttctcttccttcccttt

SEQ ID NO: 34823 - DNA, 20 bp, Artificial Sequence
  Synthetic Construct
tggttccccgagctcttttc

SEQ ID NO: 34824 - DNA, 25 bp, Artificial Sequence
  Synthetic Construct
tgggtctagaaggaaactgactttg

SEQ ID NO: 34825 - DNA, 21 bp, Artificial Sequence
  Synthetic Construct
gggctcagggagaaaatcaca

SEQ ID NO: 34826 - DNA, 21 bp, Artificial Sequence
  Synthetic Construct
tgagtcttacggggacgaagt

SEQ ID NO: 34827 - DNA, 24 bp, Artificial Sequence
  Synthetic Construct
gatgaccttgccagagaaaacaga

SEQ ID NO: 34828 - DNA, 20 bp, Artificial Sequence
  Synthetic Construct
gcagggctcctgggctaatg

SEQ ID NO: 34829 - DNA, 28 bp, Artificial Sequence
  Synthetic Construct
cctgtgagcaaaagaaagtacaggctat

SEQ ID NO: 34830 - DNA, 18 bp, Artificial Sequence
  Synthetic Construct
aggaacacggggccattg

SEQ ID NO: 34831 - DNA, 20 bp, Artificial Sequence
  Synthetic Construct
agcatctctctgccctgtga

SEQ ID NO: 34832 - DNA, 25 bp, Artificial Sequence
  Synthetic Construct
ggtttgtggtcagtgactccttgta

SEQ ID NO: 34833 - DNA, 18 bp, Artificial Sequence
  Synthetic Construct
aggtgggtgggagcagaa

SEQ ID NO: 34834 - DNA, 20 bp, Artificial Sequence
  Synthetic Construct
ggcacttggcaggcaaaaca

SEQ ID NO: 34835 - DNA, 22 bp, Artificial Sequence
  Synthetic Construct
tctgggaagagcaatggagtct

SEQ ID NO: 34836 - DNA, 20 bp, Artificial Sequence
  Synthetic Construct
tgcgcaagtccacagtgagt

SEQ ID NO: 34837 - DNA, 20 bp, Artificial Sequence
  Synthetic Construct
ggctcaatgcctggccctat

SEQ ID NO: 34838 - DNA, 25 bp, Artificial Sequence
  Synthetic Construct
ctgagaaaggaggcttcttgggatt

SEQ ID NO: 34839 - DNA, 19 bp, Artificial Sequence
  Synthetic Construct
cgcgtcccatgacgtgaac

SEQ ID NO: 34840 - DNA, 20 bp, Artificial Sequence
  Synthetic Construct
tttccgcatggcctgtcatc

SEQ ID NO: 34841 - DNA, 22 bp, Artificial Sequence
  Synthetic Construct
tggggacagaggagtcctaact

SEQ ID NO: 34842 - DNA, 26 bp, Artificial Sequence
  Synthetic Construct
ctctctgtgtaggctgagtttctttg

SEQ ID NO: 34843 - DNA, 25 bp, Artificial Sequence
  Synthetic Construct
ccatctgtgacccttgcatagttag

SEQ ID NO: 34844 - DNA, 27 bp, Artificial Sequence
  Synthetic Construct
agaagttctgccctaaataacctctac

SEQ ID NO: 34845 - DNA, 24 bp, Artificial Sequence
  Synthetic Construct
tctcactacaaaaacccagtgctt

SEQ ID NO: 34846 - DNA, 23 bp, Artificial Sequence
  Synthetic Construct
gttgaacaatgagccccatccat

SEQ ID NO: 34847 - DNA, 19 bp, Artificial Sequence
  Synthetic Construct
ggccatgcagaccctctgt

SEQ ID NO: 34848 - DNA, 22 bp, Artificial Sequence
  Synthetic Construct
cctgggtgaagccaagaaccta

SEQ ID NO: 34849 - DNA, 22 bp, Artificial Sequence
  Synthetic Construct
cccctgctacagaatgcagctt

SEQ ID NO: 34850 - DNA, 23 bp, Artificial Sequence
  Synthetic Construct
acaggggatgtaaacccactttg

SEQ ID NO: 34851 - DNA, 27 bp, Artificial Sequence
  Synthetic Construct
gcatatgtcctagaacaacctgagcat

SEQ ID NO: 34852 - DNA, 24 bp, Artificial Sequence
  Synthetic Construct
ccactatatgcctggggacctcaa

SEQ ID NO: 34853 - DNA, 23 bp, Artificial Sequence
  Synthetic Construct
agtggggacatagggaaaagtgt

SEQ ID NO: 34854 - DNA, 22 bp, Artificial Sequence
  Synthetic Construct
ccatggggaatctgggcaatca

SEQ ID NO: 34855 - DNA, 25 bp, Artificial Sequence
  Synthetic Construct
ccatgtctagtcaagggcaggtaga

SEQ ID NO: 34856 - DNA, 24 bp, Artificial Sequence
  Synthetic Construct
gtgttcaaattgcagtgctctgtt

SEQ ID NO: 34857 - DNA, 24 bp, Artificial Sequence
  Synthetic Construct
tctgtctgagtgaagatggagaca

SEQ ID NO: 34858 - DNA, 20 bp, Artificial Sequence
  Synthetic Construct
gcaccagccagggataccat

SEQ ID NO: 34859 - DNA, 27 bp, Artificial Sequence
  Synthetic Construct
cccacaggttttagcaaatgactgctt

SEQ ID NO: 34860 - DNA, 25 bp, Artificial Sequence
  Synthetic Construct
gctgtctgctctatcttccaaatgt

SEQ ID NO: 34861 - DNA, 21 bp, Artificial Sequence
  Synthetic Construct
gggagctgaggacctgcaatc

SEQ ID NO: 34862 - DNA, 25 bp, Artificial Sequence
  Synthetic Construct
tggcttctagagcaagagaatcaag

SEQ ID NO: 34863 - DNA, 25 bp, Artificial Sequence
  Synthetic Construct
ggctgtttcctaaggctctgtccat

SEQ ID NO: 34864 - DNA, 22 bp, Artificial Sequence
  Synthetic Construct
ccccactgctgatcaagccaaa

SEQ ID NO: 34865 - DNA, 22 bp, Artificial Sequence
  Synthetic Construct
ctgacccttccttctcccatca

SEQ ID NO: 34866 - DNA, 24 bp, Artificial Sequence
  Synthetic Construct
ccctagaaagcaactccagccaaa

SEQ ID NO: 34867 - DNA, 26 bp, Artificial Sequence
  Synthetic Construct
ccccattaagaaaagtcagcagtatc

SEQ ID NO: 34868 - DNA, 24 bp, Artificial Sequence
  Synthetic Construct
tgtcaatggatttccagctcacat

SEQ ID NO: 34869 - DNA, 20 bp, Artificial Sequence
  Synthetic Construct
agggttcagggcatctgtct

SEQ ID NO: 34870 - DNA, 22 bp, Artificial Sequence
  Synthetic Construct
tggtgtctccctgtggaacaga

SEQ ID NO: 34871 - DNA, 25 bp, Artificial Sequence
  Synthetic Construct
tccagctaattttacccaaccttca

SEQ ID NO: 34872 - DNA, 23 bp, Artificial Sequence
  Synthetic Construct
tggcctgtgggagtaaaaacttg

SEQ ID NO: 34873 - DNA, 24 bp, Artificial Sequence
  Synthetic Construct
ttcttcatcagcacagtgacaaac

SEQ ID NO: 34874 - DNA, 20 bp, Artificial Sequence
  Synthetic Construct
ggagccagtgctgaggaagt

SEQ ID NO: 34875 - DNA, 24 bp, Artificial Sequence
  Synthetic Construct
gaccttgtgaaggagatgctgatg

SEQ ID NO: 34876 - DNA, 26 bp, Artificial Sequence
  Synthetic Construct
tgaataagtgctcctggtctcaattc

SEQ ID NO: 34877 - DNA, 23 bp, Artificial Sequence
  Synthetic Construct
cactttggatgcatgaggctgtt

SEQ ID NO: 34878 - DNA, 21 bp, Artificial Sequence
  Synthetic Construct
ggtggtgtcaggaccatgctt

SEQ ID NO: 34879 - DNA, 23 bp, Artificial Sequence
  Synthetic Construct
cccctagccagcagagattgatg

SEQ ID NO: 34880 - DNA, 26 bp, Artificial Sequence
  Synthetic Construct
gcacttccttccttctgaagcccata

SEQ ID NO: 34881 - DNA, 24 bp, Artificial Sequence
  Synthetic Construct
tgctacttactacccgcttgatct

SEQ ID NO: 34882 - DNA, 22 bp, Artificial Sequence
  Synthetic Construct
ggaccctcagaacacctcaaca

SEQ ID NO: 34883 - DNA, 22 bp, Artificial Sequence
  Synthetic Construct
ccacctgcttgtgttggtgaca

SEQ ID NO: 34884 - DNA, 23 bp, Artificial Sequence
  Synthetic Construct
tgttagagaaggagggcgttttc

SEQ ID NO: 34885 - DNA, 22 bp, Artificial Sequence
  Synthetic Construct
gtccccactcatgcagaactga

SEQ ID NO: 34886 - DNA, 24 bp, Artificial Sequence
  Synthetic Construct
agcaccgtaattcttcacctaaca

SEQ ID NO: 34887 - DNA, 29 bp, Artificial Sequence
  Synthetic Construct
gacactttggaaatactagagctgtcctt

SEQ ID NO: 34888 - DNA, 23 bp, Artificial Sequence
  Synthetic Construct
gggaattggcctgggaaaactgt

SEQ ID NO: 34889 - DNA, 22 bp, Artificial Sequence
  Synthetic Construct
gctgtgtcctgtcattgggaat

SEQ ID NO: 34890 - DNA, 23 bp, Artificial Sequence
  Synthetic Construct
gtcacagagttccagatcccaaa

SEQ ID NO: 34891 - DNA, 23 bp, Artificial Sequence
  Synthetic Construct
cccttgtggaagagggaaagttg

SEQ ID NO: 34892 - DNA, 23 bp, Artificial Sequence
  Synthetic Construct
caatggccctactgcttttgtct

SEQ ID NO: 34893 - DNA, 21 bp, Artificial Sequence
  Synthetic Construct
cctgggtaaccagctcagcaa

SEQ ID NO: 34894 - DNA, 19 bp, Artificial Sequence
  Synthetic Construct
aggtgcggggacagtggta

SEQ ID NO: 34895 - DNA, 22 bp, Artificial Sequence
  Synthetic Construct
ccccagctgttgagagtgttga

SEQ ID NO: 34896 - DNA, 25 bp, Artificial Sequence
  Synthetic Construct
caaatgttgtcaagacatccaccat

SEQ ID NO: 34897 - DNA, 19 bp, Artificial Sequence
  Synthetic Construct
agcactgggcaggcagaca

SEQ ID NO: 34898 - DNA, 24 bp, Artificial Sequence
  Synthetic Construct
ccacacccaaggaccatatgtaac

SEQ ID NO: 34899 - DNA, 19 bp, Artificial Sequence
  Synthetic Construct
tgtgcacctcccgcttttg

SEQ ID NO: 34900 - DNA, 27 bp, Artificial Sequence
  Synthetic Construct
gcagctaatggttgtcatagggaggaa

SEQ ID NO: 34901 - DNA, 20 bp, Artificial Sequence
  Synthetic Construct
atcccagcttccgtggtttc

SEQ ID NO: 34902 - DNA, 25 bp, Artificial Sequence
  Synthetic Construct
tctacatgtaaagatgcgcttccaa

SEQ ID NO: 34903 - DNA, 20 bp, Artificial Sequence
  Synthetic Construct
tggtcgtgtccgttcctcta

SEQ ID NO: 34904 - DNA, 21 bp, Artificial Sequence
  Synthetic Construct
cccagcagagtgtctggaaca

SEQ ID NO: 34905 - DNA, 24 bp, Artificial Sequence
  Synthetic Construct
ccttgcatgtgcttctgtacattt

SEQ ID NO: 34906 - DNA, 23 bp, Artificial Sequence
  Synthetic Construct
gcattggctttgaagacggtaac

SEQ ID NO: 34907 - DNA, 21 bp, Artificial Sequence
  Synthetic Construct
accaggtgtgaggctctgcta

SEQ ID NO: 34908 - DNA, 26 bp, Artificial Sequence
  Synthetic Construct
gctatttcaataacacctggcaggaa

SEQ ID NO: 34909 - DNA, 23 bp, Artificial Sequence
  Synthetic Construct
tcaagctctgggcttcattcatc

SEQ ID NO: 34910 - DNA, 21 bp, Artificial Sequence
  Synthetic Construct
ggggcaaaggtgggcttagaa

SEQ ID NO: 34911 - DNA, 24 bp, Artificial Sequence
  Synthetic Construct
ccctacatctttgacaggctgaag

SEQ ID NO: 34912 - DNA, 19 bp, Artificial Sequence
  Synthetic Construct
cgccgtgtccttcccacaa

SEQ ID NO: 34913 - DNA, 20 bp, Artificial Sequence
  Synthetic Construct
gcatgcacctgtgagcaaca

SEQ ID NO: 34914 - DNA, 24 bp, Artificial Sequence
  Synthetic Construct
ccatgcctactcacctccagtttc

SEQ ID NO: 34915 - DNA, 22 bp, Artificial Sequence
  Synthetic Construct
cacaccatgaagagggaacgat

SEQ ID NO: 34916 - DNA, 27 bp, Artificial Sequence
  Synthetic Construct
gtgatccgtagggaatttcaagttcta

SEQ ID NO: 34917 - DNA, 22 bp, Artificial Sequence
  Synthetic Construct
aggaagggttcctgtctcttct

SEQ ID NO: 34918 - DNA, 22 bp, Artificial Sequence
  Synthetic Construct
ataggcaggcagaggccgatca

SEQ ID NO: 34919 - DNA, 28 bp, Artificial Sequence
  Synthetic Construct
gcaaagaaggtagactttgtccttcaga

SEQ ID NO: 34920 - DNA, 21 bp, Artificial Sequence
  Synthetic Construct
tccctccagcagcagttcagt

SEQ ID NO: 34921 - DNA, 20 bp, Artificial Sequence
  Synthetic Construct
tcctttcgctcccaccattg

SEQ ID NO: 34922 - DNA, 26 bp, Artificial Sequence
  Synthetic Construct
gaccaccctgtagataacacacatag

SEQ ID NO: 34923 - DNA, 18 bp, Artificial Sequence
  Synthetic Construct
tgcctgcagcacagtgaa

SEQ ID NO: 34924 - DNA, 18 bp, Artificial Sequence
  Synthetic Construct
acgcgcagccacaccaaa

SEQ ID NO: 34925 - DNA, 22 bp, Artificial Sequence
  Synthetic Construct
ccccaaatcctcactggcacaa

SEQ ID NO: 34926 - DNA, 22 bp, Artificial Sequence
  Synthetic Construct
actcactggagcccacagtatc

SEQ ID NO: 34927 - DNA, 23 bp, Artificial Sequence
  Synthetic Construct
ccaagcaggtattggcttagttg

SEQ ID NO: 34928 - DNA, 20 bp, Artificial Sequence
  Synthetic Construct
tgggaaggcagacgggttta

SEQ ID NO: 34929 - DNA, 30 bp, Artificial Sequence
  Synthetic Construct
gccactatatctgtatctccttttgcacat

SEQ ID NO: 34930 - DNA, 19 bp, Artificial Sequence
  Synthetic Construct
ccacctgggccaacctgaa

SEQ ID NO: 34931 - DNA, 24 bp, Artificial Sequence
  Synthetic Construct
cgacctcttcggatctatgactgt

SEQ ID NO: 34932 - DNA, 20 bp, Artificial Sequence
  Synthetic Construct
gcccatttcggcctctgact

SEQ ID NO: 34933 - DNA, 25 bp, Artificial Sequence
  Synthetic Construct
ggctcatcttaacaaggatgtgaga

SEQ ID NO: 34934 - DNA, 23 bp, Artificial Sequence
  Synthetic Construct
ggagagacctacccgaaatccaa

SEQ ID NO: 34935 - DNA, 24 bp, Artificial Sequence
  Synthetic Construct
gggacattggtgacctggttggtt

SEQ ID NO: 34936 - DNA, 22 bp, Artificial Sequence
  Synthetic Construct
gccccactcaacaccttcattg

SEQ ID NO: 34937 - DNA, 20 bp, Artificial Sequence
  Synthetic Construct
tgggacacctggccttgttg

SEQ ID NO: 34938 - DNA, 24 bp, Artificial Sequence
  Synthetic Construct
ggtcaggaatttgggttgaacttg

SEQ ID NO: 34939 - DNA, 26 bp, Artificial Sequence
  Synthetic Construct
gctttctgcaagagggacagaaaagt

SEQ ID NO: 34940 - DNA, 22 bp, Artificial Sequence
  Synthetic Construct
gacacagccgaaaggaaagcat

SEQ ID NO: 34941 - DNA, 25 bp, Artificial Sequence
  Synthetic Construct
gaggtttcagtatctttccctgcat

SEQ ID NO: 34942 - DNA, 20 bp, Artificial Sequence
  Synthetic Construct
aggcagccctcactttgttc

SEQ ID NO: 34943 - DNA, 22 bp, Artificial Sequence
  Synthetic Construct
gttcccagtgcttaaggcatca

SEQ ID NO: 34944 - DNA, 24 bp, Artificial Sequence
  Synthetic Construct
gcctgaggtgaaacaagcagtaag

SEQ ID NO: 34945 - DNA, 25 bp, Artificial Sequence
  Synthetic Construct
gctcccgaatagacatctcttgctt

SEQ ID NO: 34946 - DNA, 22 bp, Artificial Sequence
  Synthetic Construct
ggagagctggagacagcattca

SEQ ID NO: 34947 - DNA, 19 bp, Artificial Sequence
  Synthetic Construct
ggacagtggaggcccacat

SEQ ID NO: 34948 - DNA, 20 bp, Artificial Sequence
  Synthetic Construct
aggtggcatgaagggacaca

SEQ ID NO: 34949 - DNA, 24 bp, Artificial Sequence
  Synthetic Construct
gtgctacaaatgcctactcacctt

SEQ ID NO: 34950 - DNA, 24 bp, Artificial Sequence
  Synthetic Construct
acctctttgacaaatgcctgaagt

SEQ ID NO: 34951 - DNA, 23 bp, Artificial Sequence
  Synthetic Construct
aggttgaaatggacatggtgaca

SEQ ID NO: 34952 - DNA, 20 bp, Artificial Sequence
  Synthetic Construct
aggcccaggtttgtgtcttc

SEQ ID NO: 34953 - DNA, 21 bp, Artificial Sequence
  Synthetic Construct
ccaggagatgctcagccttca

SEQ ID NO: 34954 - DNA, 19 bp, Artificial Sequence
  Synthetic Construct
aggagctgctacggacaga

SEQ ID NO: 34955 - DNA, 22 bp, Artificial Sequence
  Synthetic Construct
cccgtgtgctcctcagtttgta

SEQ ID NO: 34956 - DNA, 20 bp, Artificial Sequence
  Synthetic Construct
agggtcgggatgagcccaaa

SEQ ID NO: 34957 - DNA, 21 bp, Artificial Sequence
  Synthetic Construct
ggcagcagagctgaatgaaag

SEQ ID NO: 34958 - DNA, 25 bp, Artificial Sequence
  Synthetic Construct
cctacaatctgagagccctttggat

SEQ ID NO: 34959 - DNA, 21 bp, Artificial Sequence
  Synthetic Construct
ccatgctaggcgtcccaaagt

SEQ ID NO: 34960 - DNA, 24 bp, Artificial Sequence
  Synthetic Construct
ctacattctcctccacagttggaa

SEQ ID NO: 34961 - DNA, 22 bp, Artificial Sequence
  Synthetic Construct
ggccttccactcaccctttttg

SEQ ID NO: 34962 - DNA, 22 bp, Artificial Sequence
  Synthetic Construct
ctgtgcccatccacttccagta

SEQ ID NO: 34963 - DNA, 20 bp, Artificial Sequence
  Synthetic Construct
tccccgccctcctccatttc

SEQ ID NO: 34964 - DNA, 19 bp, Artificial Sequence
  Synthetic Construct
acagtggcagcagctcgtt

SEQ ID NO: 34965 - DNA, 25 bp, Artificial Sequence
  Synthetic Construct
gcttccttggtagtggagtaggtaa

SEQ ID NO: 34966 - DNA, 20 bp, Artificial Sequence
  Synthetic Construct
cactgtgttgccgtgagaac

SEQ ID NO: 34967 - DNA, 25 bp, Artificial Sequence
  Synthetic Construct
gcagttttcctgtttccagcacttc

SEQ ID NO: 34968 - DNA, 24 bp, Artificial Sequence
  Synthetic Construct
ctctagaagtacagggtgggacat

SEQ ID NO: 34969 - DNA, 22 bp, Artificial Sequence
  Synthetic Construct
gggttgtgagttgacgcctgta

SEQ ID NO: 34970 - DNA, 25 bp, Artificial Sequence
  Synthetic Construct
cccttggtattaagcaaaaggcaaa

SEQ ID NO: 34971 - DNA, 22 bp, Artificial Sequence
  Synthetic Construct
cacgggcacttcacttccaaga

SEQ ID NO: 34972 - DNA, 23 bp, Artificial Sequence
  Synthetic Construct
cccagcagcttttcttctacaca

SEQ ID NO: 34973 - DNA, 22 bp, Artificial Sequence
  Synthetic Construct
gatgagggattgcttcgagctt

SEQ ID NO: 34974 - DNA, 22 bp, Artificial Sequence
  Synthetic Construct
ttccctaggggcccagctctga

SEQ ID NO: 34975 - DNA, 21 bp, Artificial Sequence
  Synthetic Construct
cctccccatgccatcttctca

SEQ ID NO: 34976 - DNA, 20 bp, Artificial Sequence
  Synthetic Construct
acactgaggtgccaggttgt

SEQ ID NO: 34977 - DNA, 21 bp, Artificial Sequence
  Synthetic Construct
cctggtgcaaagggtcagact

SEQ ID NO: 34978 - DNA, 22 bp, Artificial Sequence
  Synthetic Construct
ccaaggcaacagagcccttctt

SEQ ID NO: 34979 - DNA, 23 bp, Artificial Sequence
  Synthetic Construct
gggctcagtgctttctgttggat

SEQ ID NO: 34980 - DNA, 19 bp, Artificial Sequence
  Synthetic Construct
tgggactcctgccccactt

SEQ ID NO: 34981 - DNA, 23 bp, Artificial Sequence
  Synthetic Construct
gcaatgtgattgatccccacaaa

SEQ ID NO: 34982 - DNA, 20 bp, Artificial Sequence
  Synthetic Construct
tgggcacttccggactttct

SEQ ID NO: 34983 - DNA, 20 bp, Artificial Sequence
  Synthetic Construct
accaaaaggcggaggctcaa

SEQ ID NO: 34984 - DNA, 20 bp, Artificial Sequence
  Synthetic Construct
ggcagaagctgggagttcaa

SEQ ID NO: 34985 - DNA, 24 bp, Artificial Sequence
  Synthetic Construct
gagggatcactcactccttaggta

SEQ ID NO: 34986 - DNA, 22 bp, Artificial Sequence
  Synthetic Construct
gtgatgcacaaagccagtcatc

SEQ ID NO: 34987 - DNA, 22 bp, Artificial Sequence
  Synthetic Construct
cccatggaccaaccctcctagt

SEQ ID NO: 34988 - DNA, 24 bp, Artificial Sequence
  Synthetic Construct
caaacaaacagcaaacagcacttc

SEQ ID NO: 34989 - DNA, 24 bp, Artificial Sequence
  Synthetic Construct
gcaatcccaacaggatgtatctca

SEQ ID NO: 34990 - DNA, 20 bp, Artificial Sequence
  Synthetic Construct
agtgaggcgtctccccattc

SEQ ID NO: 34991 - DNA, 23 bp, Artificial Sequence
  Synthetic Construct
gtagaatagccggggattgtcat

SEQ ID NO: 34992 - DNA, 24 bp, Artificial Sequence
  Synthetic Construct
gtcaccatcaacacctctgacaac

SEQ ID NO: 34993 - DNA, 23 bp, Artificial Sequence
  Synthetic Construct
ggccatacagtctctgtcacaac

SEQ ID NO: 34994 - DNA, 25 bp, Artificial Sequence
  Synthetic Construct
ggagactctaaatggttcccagaat

SEQ ID NO: 34995 - DNA, 24 bp, Artificial Sequence
  Synthetic Construct
ccaagcttatggtgggaacaggaa

SEQ ID NO: 34996 - DNA, 23 bp, Artificial Sequence
  Synthetic Construct
gttgggtgggattgttcctatca

SEQ ID NO: 34997 - DNA, 23 bp, Artificial Sequence
  Synthetic Construct
ctgatgcctgacctgactgttac

SEQ ID NO: 34998 - DNA, 19 bp, Artificial Sequence
  Synthetic Construct
agctaggcgagggaaggtt

SEQ ID NO: 34999 - DNA, 21 bp, Artificial Sequence
  Synthetic Construct
gccatatgattgccccagctt

SEQ ID NO: 35000 - DNA, 22 bp, Artificial Sequence
  Synthetic Construct
gtcagtagtcgagccaggattg

SEQ ID NO: 35001 - DNA, 22 bp, Artificial Sequence
  Synthetic Construct
acccaaggatctccatgcacta

SEQ ID NO: 35002 - DNA, 23 bp, Artificial Sequence
  Synthetic Construct
gcagggccttcctttctaacaga

SEQ ID NO: 35003 - DNA, 21 bp, Artificial Sequence
  Synthetic Construct
agccctgtgaaggagcactgt

SEQ ID NO: 35004 - DNA, 21 bp, Artificial Sequence
  Synthetic Construct
agaaggtgaaggtcccaggaa

SEQ ID NO: 35005 - DNA, 19 bp, Artificial Sequence
  Synthetic Construct
gcagctctggctggtctca

SEQ ID NO: 35006 - DNA, 22 bp, Artificial Sequence
  Synthetic Construct
cctcctcttcctgcctcgttat

SEQ ID NO: 35007 - DNA, 25 bp, Artificial Sequence
  Synthetic Construct
gtggaatggagggtaggtgagaaaa

SEQ ID NO: 35008 - DNA, 26 bp, Artificial Sequence
  Synthetic Construct
agtatgctacagtttgagctggttag

SEQ ID NO: 35009 - DNA, 24 bp, Artificial Sequence
  Synthetic Construct
gcctatgtacacatggggtattca

SEQ ID NO: 35010 - DNA, 20 bp, Artificial Sequence
  Synthetic Construct
tgcctgcaccagcattttca

SEQ ID NO: 35011 - DNA, 22 bp, Artificial Sequence
  Synthetic Construct
gagacatcacagtgacctgcat

SEQ ID NO: 35012 - DNA, 22 bp, Artificial Sequence
  Synthetic Construct
ccctccttccctgtgaggaatg

SEQ ID NO: 35013 - DNA, 27 bp, Artificial Sequence
  Synthetic Construct
gatagtggaaagtgagactaagaggtt

SEQ ID NO: 35014 - DNA, 20 bp, Artificial Sequence
  Synthetic Construct
gaagccaaggagcagcaaac

SEQ ID NO: 35015 - DNA, 23 bp, Artificial Sequence
  Synthetic Construct
ccagtgcattaggctggaaggaa

SEQ ID NO: 35016 - DNA, 22 bp, Artificial Sequence
  Synthetic Construct
ggtgtctggcctcagaacacta

SEQ ID NO: 35017 - DNA, 20 bp, Artificial Sequence
  Synthetic Construct
tgcctgctgggaaaccaaga

SEQ ID NO: 35018 - DNA, 18 bp, Artificial Sequence
  Synthetic Construct
tgggcaaggcctccatct

SEQ ID NO: 35019 - DNA, 19 bp, Artificial Sequence
  Synthetic Construct
acccctgcagcttccatgt

SEQ ID NO: 35020 - DNA, 22 bp, Artificial Sequence
  Synthetic Construct
cctcctcccttcctgtgtggta

SEQ ID NO: 35021 - DNA, 23 bp, Artificial Sequence
  Synthetic Construct
tgcagagtatttggagggcaaaa

SEQ ID NO: 35022 - DNA, 22 bp, Artificial Sequence
  Synthetic Construct
tctttcttcccctcctccatgt

SEQ ID NO: 35023 - DNA, 25 bp, Artificial Sequence
  Synthetic Construct
ccaggaatcctaaccgctagaccat

SEQ ID NO: 35024 - DNA, 20 bp, Artificial Sequence
  Synthetic Construct
gcgctgaaggctagagaaca

SEQ ID NO: 35025 - DNA, 22 bp, Artificial Sequence
  Synthetic Construct
caggtgccttggtgttgagttc

SEQ ID NO: 35026 - DNA, 20 bp, Artificial Sequence
  Synthetic Construct
tgacacggactccccagatt

SEQ ID NO: 35027 - DNA, 30 bp, Artificial Sequence
  Synthetic Construct
gagaggatcatacatttacaagacctgaag

SEQ ID NO: 35028 - DNA, 25 bp, Artificial Sequence
  Synthetic Construct
ccggtaggggcatttctatttccat

SEQ ID NO: 35029 - DNA, 23 bp, Artificial Sequence
  Synthetic Construct
agtgataaggacctgtggtggaa

SEQ ID NO: 35030 - DNA, 29 bp, Artificial Sequence
  Synthetic Construct
ggctgaacccactaattagaaacacttac

SEQ ID NO: 35031 - DNA, 19 bp, Artificial Sequence
  Synthetic Construct
tgccccaaaccagcatgaa

SEQ ID NO: 35032 - DNA, 24 bp, Artificial Sequence
  Synthetic Construct
cgtgtgcctttccacctaggacat

SEQ ID NO: 35033 - DNA, 20 bp, Artificial Sequence
  Synthetic Construct
cgtgccgcggctagaactaa

SEQ ID NO: 35034 - DNA, 24 bp, Artificial Sequence
  Synthetic Construct
ggagaagctcatggatcgcgtttg

SEQ ID NO: 35035 - DNA, 24 bp, Artificial Sequence
  Synthetic Construct
gcaccgtaagggtagaaagcagtt

SEQ ID NO: 35036 - DNA, 18 bp, Artificial Sequence
  Synthetic Construct
tgcgtgcgagcaaacctt

SEQ ID NO: 35037 - DNA, 23 bp, Artificial Sequence
  Synthetic Construct
ggctgttgcatactcagccatca

SEQ ID NO: 35038 - DNA, 24 bp, Artificial Sequence
  Synthetic Construct
tcttgaccatggaaagttctgtca

SEQ ID NO: 35039 - DNA, 24 bp, Artificial Sequence
  Synthetic Construct
gccagcaagaaagggaaggcttag

SEQ ID NO: 35040 - DNA, 22 bp, Artificial Sequence
  Synthetic Construct
ctctgggcagtgttgctgaaag

SEQ ID NO: 35041 - DNA, 26 bp, Artificial Sequence
  Synthetic Construct
cagcagaacttacaaagcttccatga

SEQ ID NO: 35042 - DNA, 20 bp, Artificial Sequence
  Synthetic Construct
tcagccccagaccctgctat

SEQ ID NO: 35043 - DNA, 19 bp, Artificial Sequence
  Synthetic Construct
gggaggccagcctgaagta

SEQ ID NO: 35044 - DNA, 25 bp, Artificial Sequence
  Synthetic Construct
ggaacaacactgacccttgcagatg

SEQ ID NO: 35045 - DNA, 19 bp, Artificial Sequence
  Synthetic Construct
tgggtcgatgggtgtggtt

SEQ ID NO: 35046 - DNA, 25 bp, Artificial Sequence
  Synthetic Construct
cagacttccatagttgcctttctct

SEQ ID NO: 35047 - DNA, 24 bp, Artificial Sequence
  Synthetic Construct
ccccgaaattcaccctgtaaacat

SEQ ID NO: 35048 - DNA, 21 bp, Artificial Sequence
  Synthetic Construct
ggctgactctgaagagccttt

SEQ ID NO: 35049 - DNA, 22 bp, Artificial Sequence
  Synthetic Construct
ccacacaggcacttgtccttca

SEQ ID NO: 35050 - DNA, 24 bp, Artificial Sequence
  Synthetic Construct
ggagaaataggcccacctcagtca

SEQ ID NO: 35051 - DNA, 25 bp, Artificial Sequence
  Synthetic Construct
tgggttttaaagcaatggagtcaag

SEQ ID NO: 35052 - DNA, 20 bp, Artificial Sequence
  Synthetic Construct
gggtcaaatgggctgtggaa

SEQ ID NO: 35053 - DNA, 21 bp, Artificial Sequence
  Synthetic Construct
gccttaccattgcctcccaaa

SEQ ID NO: 35054 - DNA, 21 bp, Artificial Sequence
  Synthetic Construct
gaccatctccaaagccctgaa

SEQ ID NO: 35055 - DNA, 21 bp, Artificial Sequence
  Synthetic Construct
aggcagcagggtcaccttgaa

SEQ ID NO: 35056 - DNA, 26 bp, Artificial Sequence
  Synthetic Construct
ggctttgtcaagcaatcaggcttaga

SEQ ID NO: 35057 - DNA, 23 bp, Artificial Sequence
  Synthetic Construct
cctcccacaaaatctgctgctta

SEQ ID NO: 35058 - DNA, 21 bp, Artificial Sequence
  Synthetic Construct
ggcctcacagtcatggtgttg

SEQ ID NO: 35059 - DNA, 23 bp, Artificial Sequence
  Synthetic Construct
tgtctcccatattgggctgatct

SEQ ID NO: 35060 - DNA, 19 bp, Artificial Sequence
  Synthetic Construct
tctggcccttggtgcacat

SEQ ID NO: 35061 - DNA, 19 bp, Artificial Sequence
  Synthetic Construct
gccagccccaggtgtttga

SEQ ID NO: 35062 - DNA, 26 bp, Artificial Sequence
  Synthetic Construct
gcccttatcttcccagtaacaggttt

SEQ ID NO: 35063 - DNA, 22 bp, Artificial Sequence
  Synthetic Construct
ttcctcgcctcctactgtgaga

SEQ ID NO: 35064 - DNA, 23 bp, Artificial Sequence
  Synthetic Construct
atttaccaaaggggcagaactca

SEQ ID NO: 35065 - DNA, 24 bp, Artificial Sequence
  Synthetic Construct
gccacaattgctgcctgaatggat

SEQ ID NO: 35066 - DNA, 25 bp, Artificial Sequence
  Synthetic Construct
tgaatgatgcctatcaagtgtgtgt

SEQ ID NO: 35067 - DNA, 21 bp, Artificial Sequence
  Synthetic Construct
gctggccttcctcacctttca

SEQ ID NO: 35068 - DNA, 22 bp, Artificial Sequence
  Synthetic Construct
aggccaggattcagggctttac

SEQ ID NO: 35069 - DNA, 22 bp, Artificial Sequence
  Synthetic Construct
gcccactggaacctctctttga

SEQ ID NO: 35070 - DNA, 20 bp, Artificial Sequence
  Synthetic Construct
gcgtgatgctgggacactaa

SEQ ID NO: 35071 - DNA, 23 bp, Artificial Sequence
  Synthetic Construct
gcctcctgatgcatgttgactga

SEQ ID NO: 35072 - DNA, 25 bp, Artificial Sequence
  Synthetic Construct
gccactgaggtttactgagtcattg

SEQ ID NO: 35073 - DNA, 20 bp, Artificial Sequence
  Synthetic Construct
agtgggtctgccaagcaaca

SEQ ID NO: 35074 - DNA, 24 bp, Artificial Sequence
  Synthetic Construct
ggcattgtctgatagcgagggaaa

SEQ ID NO: 35075 - DNA, 20 bp, Artificial Sequence
  Synthetic Construct
accgggtgaggctcctactt

SEQ ID NO: 35076 - DNA, 25 bp, Artificial Sequence
  Synthetic Construct
gttactgtcatagctggaacagact

SEQ ID NO: 35077 - DNA, 26 bp, Artificial Sequence
  Synthetic Construct
gcacaactcctgcctatttatctaac

SEQ ID NO: 35078 - DNA, 26 bp, Artificial Sequence
  Synthetic Construct
gtccttcaaagcttcctgaaacatct

SEQ ID NO: 35079 - DNA, 23 bp, Artificial Sequence
  Synthetic Construct
ccatcccctgtattcctgtcttc

SEQ ID NO: 35080 - DNA, 21 bp, Artificial Sequence
  Synthetic Construct
cctgagccattcctcttgctt

SEQ ID NO: 35081 - DNA, 26 bp, Artificial Sequence
  Synthetic Construct
ggatatctgtgtacgtctgtgtgtca

SEQ ID NO: 35082 - DNA, 23 bp, Artificial Sequence
  Synthetic Construct
cttaccctcttcccctcttctgt

SEQ ID NO: 35083 - DNA, 22 bp, Artificial Sequence
  Synthetic Construct
ggctgggagtctgcaactacat

SEQ ID NO: 35084 - DNA, 28 bp, Artificial Sequence
  Synthetic Construct
gccagaagtggagagtagacttcctaaa

SEQ ID NO: 35085 - DNA, 25 bp, Artificial Sequence
  Synthetic Construct
ggggtagaaagaagtggacgggatt

SEQ ID NO: 35086 - DNA, 23 bp, Artificial Sequence
  Synthetic Construct
gtgaaagtggagggaagtgttgt

SEQ ID NO: 35087 - DNA, 25 bp, Artificial Sequence
  Synthetic Construct
gtgtgagacttggtttggtgtgaac

SEQ ID NO: 35088 - DNA, 23 bp, Artificial Sequence
  Synthetic Construct
ggtcagtgctgtcattcagatca

SEQ ID NO: 35089 - DNA, 21 bp, Artificial Sequence
  Synthetic Construct
acccatgccctggacctgtaa

SEQ ID NO: 35090 - DNA, 22 bp, Artificial Sequence
  Synthetic Construct
tcagcagcggagatcctgtaga

SEQ ID NO: 35091 - DNA, 23 bp, Artificial Sequence
  Synthetic Construct
acctaaattcggccactttccat

SEQ ID NO: 35092 - DNA, 22 bp, Artificial Sequence
  Synthetic Construct
tgtagtttgagggcctggaatc

SEQ ID NO: 35093 - DNA, 20 bp, Artificial Sequence
  Synthetic Construct
agttggggcacccaccacta

SEQ ID NO: 35094 - DNA, 22 bp, Artificial Sequence
  Synthetic Construct
ggtggaacacagtcacagtttg

SEQ ID NO: 35095 - DNA, 26 bp, Artificial Sequence
  Synthetic Construct
gttcaccaattagcttccatctctca

SEQ ID NO: 35096 - DNA, 25 bp, Artificial Sequence
  Synthetic Construct
gtactgtacaggcatgagttcaagt

SEQ ID NO: 35097 - DNA, 23 bp, Artificial Sequence
  Synthetic Construct
gaacgcagaatacctgggttcaa

SEQ ID NO: 35098 - DNA, 22 bp, Artificial Sequence
  Synthetic Construct
tcttacagctccttccccacaa

SEQ ID NO: 35099 - DNA, 23 bp, Artificial Sequence
  Synthetic Construct
gatggttggaacatggtgctttt

SEQ ID NO: 35100 - DNA, 20 bp, Artificial Sequence
  Synthetic Construct
agcttcaggaaggcctcaca

SEQ ID NO: 35101 - DNA, 24 bp, Artificial Sequence
  Synthetic Construct
cttggcaattttccagccttttct

SEQ ID NO: 35102 - DNA, 26 bp, Artificial Sequence
  Synthetic Construct
cctcggtctatcagttaggcttgttc

SEQ ID NO: 35103 - DNA, 22 bp, Artificial Sequence
  Synthetic Construct
gggagaaggggacacaatgaag

SEQ ID NO: 35104 - DNA, 26 bp, Artificial Sequence
  Synthetic Construct
gctcatggctgaatactgactgatag

SEQ ID NO: 35105 - DNA, 22 bp, Artificial Sequence
  Synthetic Construct
ctcaaaccacagcccagtgtag

SEQ ID NO: 35106 - DNA, 21 bp, Artificial Sequence
  Synthetic Construct
aggaggctgagttagctccaa

SEQ ID NO: 35107 - DNA, 20 bp, Artificial Sequence
  Synthetic Construct
tccccacgtgagctggtgta

SEQ ID NO: 35108 - DNA, 24 bp, Artificial Sequence
  Synthetic Construct
acttcagtgtatgccaatccaaca

SEQ ID NO: 35109 - DNA, 22 bp, Artificial Sequence
  Synthetic Construct
tggggaggcttctgatgcttga

SEQ ID NO: 35110 - DNA, 19 bp, Artificial Sequence
  Synthetic Construct
gggccttgccagccaagat

SEQ ID NO: 35111 - DNA, 27 bp, Artificial Sequence
  Synthetic Construct
cagtttaagttaccctagttccagctt

SEQ ID NO: 35112 - DNA, 25 bp, Artificial Sequence
  Synthetic Construct
ggctgagcttttcacaagttttaca

SEQ ID NO: 35113 - DNA, 26 bp, Artificial Sequence
  Synthetic Construct
agaagagtcaggatcttaaggacaga

SEQ ID NO: 35114 - DNA, 24 bp, Artificial Sequence
  Synthetic Construct
ggtgatcagagaggcctggatttc

SEQ ID NO: 35115 - DNA, 20 bp, Artificial Sequence
  Synthetic Construct
acagacacccacgcttcctt

SEQ ID NO: 35116 - DNA, 22 bp, Artificial Sequence
  Synthetic Construct
agcctcagactggtgcatctct

SEQ ID NO: 35117 - DNA, 21 bp, Artificial Sequence
  Synthetic Construct
tctgggaagtctgcagtgcta

SEQ ID NO: 35118 - DNA, 21 bp, Artificial Sequence
  Synthetic Construct
gctggaaaagctggtgagttg

SEQ ID NO: 35119 - DNA, 24 bp, Artificial Sequence
  Synthetic Construct
ggctggaagaagtccagagcaact

SEQ ID NO: 35120 - DNA, 20 bp, Artificial Sequence
  Synthetic Construct
gcccagtcagctcagattgt

SEQ ID NO: 35121 - DNA, 23 bp, Artificial Sequence
  Synthetic Construct
actgagttaaaggcagggacaag

SEQ ID NO: 35122 - DNA, 24 bp, Artificial Sequence
  Synthetic Construct
gccctggcatcatcttgattgcat

SEQ ID NO: 35123 - DNA, 26 bp, Artificial Sequence
  Synthetic Construct
cccaatttgaatgaaagcccctcgat

SEQ ID NO: 35124 - DNA, 21 bp, Artificial Sequence
  Synthetic Construct
ccagagaggttgcacccagat

SEQ ID NO: 35125 - DNA, 24 bp, Artificial Sequence
  Synthetic Construct
tctttctctctcctctcgtgaaca

SEQ ID NO: 35126 - DNA, 20 bp, Artificial Sequence
  Synthetic Construct
tccaaggacaggctgccaat

SEQ ID NO: 35127 - DNA, 27 bp, Artificial Sequence
  Synthetic Construct
actaaagctataacccctgtaccctaa

SEQ ID NO: 35128 - DNA, 21 bp, Artificial Sequence
  Synthetic Construct
agccttccgactcctcacctt

SEQ ID NO: 35129 - DNA, 22 bp, Artificial Sequence
  Synthetic Construct
gccagagagaacgtgggaactt

SEQ ID NO: 35130 - DNA, 22 bp, Artificial Sequence
  Synthetic Construct
gtgaagctctcaccgagaggaa

SEQ ID NO: 35131 - DNA, 24 bp, Artificial Sequence
  Synthetic Construct
agcaatgatgacagtgccttatga

SEQ ID NO: 35132 - DNA, 30 bp, Artificial Sequence
  Synthetic Construct
gcacagtgatgatacgaatgtcaatctttg

SEQ ID NO: 35133 - DNA, 21 bp, Artificial Sequence
  Synthetic Construct
ggccaggtgagcctcagaaaa

SEQ ID NO: 35134 - DNA, 20 bp, Artificial Sequence
  Synthetic Construct
tcctcgggtctctgtgctta

SEQ ID NO: 35135 - DNA, 22 bp, Artificial Sequence
  Synthetic Construct
cagccgatgccaggaatacaac

SEQ ID NO: 35136 - DNA, 23 bp, Artificial Sequence
  Synthetic Construct
gggaggaggcattggaggttttc

SEQ ID NO: 35137 - DNA, 24 bp, Artificial Sequence
  Synthetic Construct
cctctggctggctgaaaactcaac

SEQ ID NO: 35138 - DNA, 20 bp, Artificial Sequence
  Synthetic Construct
tgcccagtgttccagcagat

SEQ ID NO: 35139 - DNA, 18 bp, Artificial Sequence
  Synthetic Construct
agggctcgctcctgaaga

SEQ ID NO: 35140 - DNA, 24 bp, Artificial Sequence
  Synthetic Construct
ctagggtgtttttctcccatcctt

SEQ ID NO: 35141 - DNA, 20 bp, Artificial Sequence
  Synthetic Construct
cccagcccactgcaaagtca

SEQ ID NO: 35142 - DNA, 20 bp, Artificial Sequence
  Synthetic Construct
cgcagacacacagggtttga

SEQ ID NO: 35143 - DNA, 21 bp, Artificial Sequence
  Synthetic Construct
tacctaggaccctggggtaga

SEQ ID NO: 35144 - DNA, 22 bp, Artificial Sequence
  Synthetic Construct
gagaattcacttgccgggactt

SEQ ID NO: 35145 - DNA, 25 bp, Artificial Sequence
  Synthetic Construct
ggcaggataacggacactccaaatc

SEQ ID NO: 35146 - DNA, 25 bp, Artificial Sequence
  Synthetic Construct
cctccagcaggtattgccatagttc

SEQ ID NO: 35147 - DNA, 23 bp, Artificial Sequence
  Synthetic Construct
ccctcacctactacccacagact

SEQ ID NO: 35148 - DNA, 21 bp, Artificial Sequence
  Synthetic Construct
gacacacacggtatcgctgaa

SEQ ID NO: 35149 - DNA, 24 bp, Artificial Sequence
  Synthetic Construct
ccacccactggattctcccttagt

SEQ ID NO: 35150 - DNA, 20 bp, Artificial Sequence
  Synthetic Construct
tcaaggcctaggagcaggtt

SEQ ID NO: 35151 - DNA, 20 bp, Artificial Sequence
  Synthetic Construct
tctcacagggctgactcaca

SEQ ID NO: 35152 - DNA, 20 bp, Artificial Sequence
  Synthetic Construct
gagacctgccaccctactgt

SEQ ID NO: 35153 - DNA, 25 bp, Artificial Sequence
  Synthetic Construct
acactaacaccgttactgattgtga

SEQ ID NO: 35154 - DNA, 20 bp, Artificial Sequence
  Synthetic Construct
gtgatggtcaggcagctgtt

SEQ ID NO: 35155 - DNA, 19 bp, Artificial Sequence
  Synthetic Construct
ccttggggctgccaggaat

SEQ ID NO: 35156 - DNA, 25 bp, Artificial Sequence
  Synthetic Construct
gactgaagtatagtggtggggatga

SEQ ID NO: 35157 - DNA, 19 bp, Artificial Sequence
  Synthetic Construct
ccagggctgagtccaggat

SEQ ID NO: 35158 - DNA, 29 bp, Artificial Sequence
  Synthetic Construct
gccacgatacctccataattgttctgact

SEQ ID NO: 35159 - DNA, 20 bp, Artificial Sequence
  Synthetic Construct
tggggcagaggccacgatgt

SEQ ID NO: 35160 - DNA, 25 bp, Artificial Sequence
  Synthetic Construct
cctgctgtgtcagttttatggatga

SEQ ID NO: 35161 - DNA, 23 bp, Artificial Sequence
  Synthetic Construct
tctctttcctctgggtttgcatt

SEQ ID NO: 35162 - DNA, 29 bp, Artificial Sequence
  Synthetic Construct
ctgggttcttagtgcagactctaatacaa

SEQ ID NO: 35163 - DNA, 20 bp, Artificial Sequence
  Synthetic Construct
acctggcactgtgctgcttt

SEQ ID NO: 35164 - DNA, 24 bp, Artificial Sequence
  Synthetic Construct
gctggaggaaaatgtgagttcaag

SEQ ID NO: 35165 - DNA, 24 bp, Artificial Sequence
  Synthetic Construct
cctggagctaatttcacccagttc

SEQ ID NO: 35166 - DNA, 20 bp, Artificial Sequence
  Synthetic Construct
atcccagaaggcggcagaat

SEQ ID NO: 35167 - DNA, 24 bp, Artificial Sequence
  Synthetic Construct
tggtaacaagatccatggggagat

SEQ ID NO: 35168 - DNA, 23 bp, Artificial Sequence
  Synthetic Construct
gtgtatttgcagcaggtcactgt

SEQ ID NO: 35169 - DNA, 26 bp, Artificial Sequence
  Synthetic Construct
gggagaaggatctgggatttctgaca

SEQ ID NO: 35170 - DNA, 21 bp, Artificial Sequence
  Synthetic Construct
agaaaaccaacggtgcgacta

SEQ ID NO: 35171 - DNA, 23 bp, Artificial Sequence
  Synthetic Construct
ccacctttttcagtgggcctaga

SEQ ID NO: 35172 - DNA, 24 bp, Artificial Sequence
  Synthetic Construct
tttccttccaatgaactccacaga

SEQ ID NO: 35173 - DNA, 24 bp, Artificial Sequence
  Synthetic Construct
cccaaggactctatctccctcaca

SEQ ID NO: 35174 - DNA, 21 bp, Artificial Sequence
  Synthetic Construct
tgattgtgggaggagggtaca

SEQ ID NO: 35175 - DNA, 21 bp, Artificial Sequence
  Synthetic Construct
caaactggtcttgcgcctaca

SEQ ID NO: 35176 - DNA, 21 bp, Artificial Sequence
  Synthetic Construct
ctccattgctggcagatgctt

SEQ ID NO: 35177 - DNA, 25 bp, Artificial Sequence
  Synthetic Construct
cccaggtctcaaacttgttcagttg

SEQ ID NO: 35178 - DNA, 29 bp, Artificial Sequence
  Synthetic Construct
ctcaaacctggacacaggataaacttttg

SEQ ID NO: 35179 - DNA, 24 bp, Artificial Sequence
  Synthetic Construct
tgtgagcactttgaggacaaaatc

SEQ ID NO: 35180 - DNA, 25 bp, Artificial Sequence
  Synthetic Construct
ggctgatttgtaaacggctttccat

SEQ ID NO: 35181 - DNA, 22 bp, Artificial Sequence
  Synthetic Construct
agctccttcccagagcatcaac

SEQ ID NO: 35182 - DNA, 22 bp, Artificial Sequence
  Synthetic Construct
taggtggggatgtcccctgttg

SEQ ID NO: 35183 - DNA, 23 bp, Artificial Sequence
  Synthetic Construct
gtctaaggcaatggcttcacttc

SEQ ID NO: 35184 - DNA, 24 bp, Artificial Sequence
  Synthetic Construct
gacaattctcaggagtggtgcttt

SEQ ID NO: 35185 - DNA, 22 bp, Artificial Sequence
  Synthetic Construct
cgacacggtgcctcctataatg

SEQ ID NO: 35186 - DNA, 25 bp, Artificial Sequence
  Synthetic Construct
gtgattaaatcccaggagtgtgtgt

SEQ ID NO: 35187 - DNA, 22 bp, Artificial Sequence
  Synthetic Construct
ttggtgtctgggcaaggtctac

SEQ ID NO: 35188 - DNA, 21 bp, Artificial Sequence
  Synthetic Construct
aggctcactgcctgagaggat

SEQ ID NO: 35189 - DNA, 23 bp, Artificial Sequence
  Synthetic Construct
ggcaacaaagtttaggcagacaa

SEQ ID NO: 35190 - DNA, 20 bp, Artificial Sequence
  Synthetic Construct
gtccttccccttcccaggtt

SEQ ID NO: 35191 - DNA, 23 bp, Artificial Sequence
  Synthetic Construct
gccaacctaaagcaagctcaaac

SEQ ID NO: 35192 - DNA, 21 bp, Artificial Sequence
  Synthetic Construct
tgcaagggcctgtctcccatt

SEQ ID NO: 35193 - DNA, 22 bp, Artificial Sequence
  Synthetic Construct
gagaccagatgctgggaaatca

SEQ ID NO: 35194 - DNA, 23 bp, Artificial Sequence
  Synthetic Construct
gggaggtggtactgtaggtggtt

SEQ ID NO: 35195 - DNA, 21 bp, Artificial Sequence
  Synthetic Construct
caaagatcagggtgccagcat

SEQ ID NO: 35196 - DNA, 22 bp, Artificial Sequence
  Synthetic Construct
gtccttcccagaactccaggat

SEQ ID NO: 35197 - DNA, 20 bp, Artificial Sequence
  Synthetic Construct
aaatcggggcactccagctt

SEQ ID NO: 35198 - DNA, 24 bp, Artificial Sequence
  Synthetic Construct
ggaggaggaagggaaggagatttt

SEQ ID NO: 35199 - DNA, 24 bp, Artificial Sequence
  Synthetic Construct
ccatggggagtactgccagactat

SEQ ID NO: 35200 - DNA, 22 bp, Artificial Sequence
  Synthetic Construct
agtccagctgctgtaatgaaca

SEQ ID NO: 35201 - DNA, 22 bp, Artificial Sequence
  Synthetic Construct
ccaaggaaagctgctgaagtga

SEQ ID NO: 35202 - DNA, 21 bp, Artificial Sequence
  Synthetic Construct
agagccacgctgacccatact

SEQ ID NO: 35203 - DNA, 22 bp, Artificial Sequence
  Synthetic Construct
ctgagggaaagccaatgcaaag

SEQ ID NO: 35204 - DNA, 25 bp, Artificial Sequence
  Synthetic Construct
ggagtcatttttcactctgcgctta

SEQ ID NO: 35205 - DNA, 23 bp, Artificial Sequence
  Synthetic Construct
ccctttccactgcctgttactgt

SEQ ID NO: 35206 - DNA, 20 bp, Artificial Sequence
  Synthetic Construct
actctgggtgctgtgcattc

SEQ ID NO: 35207 - DNA, 26 bp, Artificial Sequence
  Synthetic Construct
ccccaagtcacacgttacttatcatc

SEQ ID NO: 35208 - DNA, 27 bp, Artificial Sequence
  Synthetic Construct
agaggaatggaactgcatgagtattag

SEQ ID NO: 35209 - DNA, 25 bp, Artificial Sequence
  Synthetic Construct
tcatctgttgggagtctaggattgt

SEQ ID NO: 35210 - DNA, 24 bp, Artificial Sequence
  Synthetic Construct
cttgggcagtgaataagaggcttt

SEQ ID NO: 35211 - DNA, 23 bp, Artificial Sequence
  Synthetic Construct
tgtggtttagcgtctgacctagt

SEQ ID NO: 35212 - DNA, 23 bp, Artificial Sequence
  Synthetic Construct
ccccattgatggcttggacatga

SEQ ID NO: 35213 - DNA, 23 bp, Artificial Sequence
  Synthetic Construct
gtgcctcatctcactgacccaaa

SEQ ID NO: 35214 - DNA, 22 bp, Artificial Sequence
  Synthetic Construct
gggtcagagtgttggcctaagt

SEQ ID NO: 35215 - DNA, 23 bp, Artificial Sequence
  Synthetic Construct
ctgctgtgaaagggaagctgact

SEQ ID NO: 35216 - DNA, 24 bp, Artificial Sequence
  Synthetic Construct
gtccagggatagtaaggcagtttg

SEQ ID NO: 35217 - DNA, 21 bp, Artificial Sequence
  Synthetic Construct
acccaccggctctatctcaca

SEQ ID NO: 35218 - DNA, 20 bp, Artificial Sequence
  Synthetic Construct
tggaggagcgtggcaacaat

SEQ ID NO: 35219 - DNA, 22 bp, Artificial Sequence
  Synthetic Construct
ctggagggcagtggtacaatca

SEQ ID NO: 35220 - DNA, 20 bp, Artificial Sequence
  Synthetic Construct
ggccttgtgcagaactgaga

SEQ ID NO: 35221 - DNA, 26 bp, Artificial Sequence
  Synthetic Construct
gtcacttgactgctttcctaatcact

SEQ ID NO: 35222 - DNA, 18 bp, Artificial Sequence
  Synthetic Construct
tcagtgcctggcgcagta

SEQ ID NO: 35223 - DNA, 23 bp, Artificial Sequence
  Synthetic Construct
gcccttcttagtcctgtggattc

SEQ ID NO: 35224 - DNA, 25 bp, Artificial Sequence
  Synthetic Construct
ccaaaatcaatatgggctccacaca

SEQ ID NO: 35225 - DNA, 24 bp, Artificial Sequence
  Synthetic Construct
ccctgcctgtctcaatgaggtcaa

SEQ ID NO: 35226 - DNA, 24 bp, Artificial Sequence
  Synthetic Construct
ggggaacaggatatagacccatga

SEQ ID NO: 35227 - DNA, 23 bp, Artificial Sequence
  Synthetic Construct
cctgatcagaagctacgctgtgt

SEQ ID NO: 35228 - DNA, 22 bp, Artificial Sequence
  Synthetic Construct
tcttcacccagagggaaagact

SEQ ID NO: 35229 - DNA, 20 bp, Artificial Sequence
  Synthetic Construct
tggcataccagcgtgtttca

SEQ ID NO: 35230 - DNA, 24 bp, Artificial Sequence
  Synthetic Construct
cccagaggaagcatggaactgaag

SEQ ID NO: 35231 - DNA, 21 bp, Artificial Sequence
  Synthetic Construct
gccacaccccttcctgttctt

SEQ ID NO: 35232 - DNA, 26 bp, Artificial Sequence
  Synthetic Construct
gtgttcttgcttttgaaggacaggat

SEQ ID NO: 35233 - DNA, 22 bp, Artificial Sequence
  Synthetic Construct
ccctgcccaagcaagacatttg

SEQ ID NO: 35234 - DNA, 23 bp, Artificial Sequence
  Synthetic Construct
gctcagagaagcagtcccaatgt

SEQ ID NO: 35235 - DNA, 20 bp, Artificial Sequence
  Synthetic Construct
tggggtcatgtggggtgaaa

SEQ ID NO: 35236 - DNA, 25 bp, Artificial Sequence
  Synthetic Construct
ttatggcagctagatgaaggaactt

SEQ ID NO: 35237 - DNA, 18 bp, Artificial Sequence
  Synthetic Construct
agccagctgcgcacaaaa

SEQ ID NO: 35238 - DNA, 21 bp, Artificial Sequence
  Synthetic Construct
tcctccccagtctgctccttt

SEQ ID NO: 35239 - DNA, 25 bp, Artificial Sequence
  Synthetic Construct
gctaacggtccatcaagacttccaa

SEQ ID NO: 35240 - DNA, 24 bp, Artificial Sequence
  Synthetic Construct
acacatttgactttggctggagaa

SEQ ID NO: 35241 - DNA, 20 bp, Artificial Sequence
  Synthetic Construct
tctgcctaagctggggatca

SEQ ID NO: 35242 - DNA, 20 bp, Artificial Sequence
  Synthetic Construct
agtgaagacgctccctgcat

SEQ ID NO: 35243 - DNA, 20 bp, Artificial Sequence
  Synthetic Construct
aacctggcagctggtgttag

SEQ ID NO: 35244 - DNA, 19 bp, Artificial Sequence
  Synthetic Construct
tcgcactcccagcctgaat

SEQ ID NO: 35245 - DNA, 20 bp, Artificial Sequence
  Synthetic Construct
ccttgtgcagtggccaaaaa

SEQ ID NO: 35246 - DNA, 25 bp, Artificial Sequence
  Synthetic Construct
ggtgatgaagttttgtgctctttct

SEQ ID NO: 35247 - DNA, 30 bp, Artificial Sequence
  Synthetic Construct
ccacttcaaactctgcacttttatccttct

SEQ ID NO: 35248 - DNA, 26 bp, Artificial Sequence
  Synthetic Construct
cctatgaatggactttgttcctgttc

SEQ ID NO: 35249 - DNA, 19 bp, Artificial Sequence
  Synthetic Construct
tcggctgcaccaggacgaa

SEQ ID NO: 35250 - DNA, 24 bp, Artificial Sequence
  Synthetic Construct
tctctaactggactctgggacttc

SEQ ID NO: 35251 - DNA, 25 bp, Artificial Sequence
  Synthetic Construct
gctgaactggaagatccaaccaact

SEQ ID NO: 35252 - DNA, 22 bp, Artificial Sequence
  Synthetic Construct
aagaggctcccctagtcagctt

SEQ ID NO: 35253 - DNA, 22 bp, Artificial Sequence
  Synthetic Construct
gcagcctctgcactctggattt

SEQ ID NO: 35254 - DNA, 20 bp, Artificial Sequence
  Synthetic Construct
agtgtgccacagtgatgcaa

SEQ ID NO: 35255 - DNA, 24 bp, Artificial Sequence
  Synthetic Construct
accccagttctttagctgagattg

SEQ ID NO: 35256 - DNA, 20 bp, Artificial Sequence
  Synthetic Construct
gctggtgatcccacactgaa

SEQ ID NO: 35257 - DNA, 24 bp, Artificial Sequence
  Synthetic Construct
tgactcgaggagtgactaagagat

SEQ ID NO: 35258 - DNA, 20 bp, Artificial Sequence
  Synthetic Construct
tccaggtcgtagcagcagta

SEQ ID NO: 35259 - DNA, 22 bp, Artificial Sequence
  Synthetic Construct
ggcctctgtgtttggtgctgtt

SEQ ID NO: 35260 - DNA, 24 bp, Artificial Sequence
  Synthetic Construct
cgtcatcagccagaaggaatgtca

SEQ ID NO: 35261 - DNA, 20 bp, Artificial Sequence
  Synthetic Construct
acctctgcctcttgcctttc

SEQ ID NO: 35262 - DNA, 22 bp, Artificial Sequence
  Synthetic Construct
cccttttggttgctgtgctttc

SEQ ID NO: 35263 - DNA, 21 bp, Artificial Sequence
  Synthetic Construct
tggctttcttaggtcgtgctt

SEQ ID NO: 35264 - DNA, 20 bp, Artificial Sequence
  Synthetic Construct
gacatggtgggagagcacaa

SEQ ID NO: 35265 - DNA, 20 bp, Artificial Sequence
  Synthetic Construct
aggcaggtgtgcactgtatg

SEQ ID NO: 35266 - DNA, 22 bp, Artificial Sequence
  Synthetic Construct
ccaggcctttctcactctgtca

SEQ ID NO: 35267 - DNA, 20 bp, Artificial Sequence
  Synthetic Construct
ggctcctccaaccccacttc

SEQ ID NO: 35268 - DNA, 19 bp, Artificial Sequence
  Synthetic Construct
ccaccgagctgctgtgtca

SEQ ID NO: 35269 - DNA, 20 bp, Artificial Sequence
  Synthetic Construct
tccacgtgacctctctgtgt

SEQ ID NO: 35270 - DNA, 22 bp, Artificial Sequence
  Synthetic Construct
ggccagcacctggtgttttaca

SEQ ID NO: 35271 - DNA, 19 bp, Artificial Sequence
  Synthetic Construct
tggagcacagtgggtgaga

SEQ ID NO: 35272 - DNA, 22 bp, Artificial Sequence
  Synthetic Construct
ggtcattccctttgtgccaagt

SEQ ID NO: 35273 - DNA, 25 bp, Artificial Sequence
  Synthetic Construct
gctgtcatccttcattgggtgaatg

SEQ ID NO: 35274 - DNA, 22 bp, Artificial Sequence
  Synthetic Construct
ctgacccgagactgcatagctt

SEQ ID NO: 35275 - DNA, 21 bp, Artificial Sequence
  Synthetic Construct
actgcagtggtcctggtgaga

SEQ ID NO: 35276 - DNA, 26 bp, Artificial Sequence
  Synthetic Construct
tgtgcagtgatagaatggcatcttag

SEQ ID NO: 35277 - DNA, 25 bp, Artificial Sequence
  Synthetic Construct
agtactgtgctagaaggtgatgcta

SEQ ID NO: 35278 - DNA, 22 bp, Artificial Sequence
  Synthetic Construct
gggccctgaccaagtctttgaa

SEQ ID NO: 35279 - DNA, 21 bp, Artificial Sequence
  Synthetic Construct
tctccccaccacccatcttga

SEQ ID NO: 35280 - DNA, 19 bp, Artificial Sequence
  Synthetic Construct
tggaaagggccggttgtgt

SEQ ID NO: 35281 - DNA, 19 bp, Artificial Sequence
  Synthetic Construct
attgggcctccctgcaaag

SEQ ID NO: 35282 - DNA, 24 bp, Artificial Sequence
  Synthetic Construct
gagtagacccctaatcacagcaaa

SEQ ID NO: 35283 - DNA, 24 bp, Artificial Sequence
  Synthetic Construct
cccagttatctgcttgcgggatgt

SEQ ID NO: 35284 - DNA, 23 bp, Artificial Sequence
  Synthetic Construct
gcagacttgccaaatccctctca

SEQ ID NO: 35285 - DNA, 21 bp, Artificial Sequence
  Synthetic Construct
tctcctaggcctctgccactt

SEQ ID NO: 35286 - DNA, 20 bp, Artificial Sequence
  Synthetic Construct
ccttgagggcttggctcaaa

SEQ ID NO: 35287 - DNA, 20 bp, Artificial Sequence
  Synthetic Construct
tcccactggggcccttgtaa

SEQ ID NO: 35288 - DNA, 20 bp, Artificial Sequence
  Synthetic Construct
acccaccctggctgtgttca

SEQ ID NO: 35289 - DNA, 26 bp, Artificial Sequence
  Synthetic Construct
catggtgagtaaaagctggtaaggta

SEQ ID NO: 35290 - DNA, 20 bp, Artificial Sequence
  Synthetic Construct
acccgaggtgcctgccctaa

SEQ ID NO: 35291 - DNA, 20 bp, Artificial Sequence
  Synthetic Construct
tccctcctcacagccacttg

SEQ ID NO: 35292 - DNA, 25 bp, Artificial Sequence
  Synthetic Construct
actaagaggctgcatgcttattcaa

SEQ ID NO: 35293 - DNA, 26 bp, Artificial Sequence
  Synthetic Construct
cacccagtgtgactgaacaatgtaag

SEQ ID NO: 35294 - DNA, 22 bp, Artificial Sequence
  Synthetic Construct
gccctgttgtatgcaggacaga

SEQ ID NO: 35295 - DNA, 21 bp, Artificial Sequence
  Synthetic Construct
tgtctttcaggcctcccctta

SEQ ID NO: 35296 - DNA, 20 bp, Artificial Sequence
  Synthetic Construct
aagccagggatgcactgaag

SEQ ID NO: 35297 - DNA, 21 bp, Artificial Sequence
  Synthetic Construct
tgggcggatgtctccaactgt

SEQ ID NO: 35298 - DNA, 23 bp, Artificial Sequence
  Synthetic Construct
ctgcagacaacacagttcccttt

SEQ ID NO: 35299 - DNA, 22 bp, Artificial Sequence
  Synthetic Construct
ccctacaagtgtggacctctca

SEQ ID NO: 35300 - DNA, 20 bp, Artificial Sequence
  Synthetic Construct
ggagatggcgtgaagtcgat

SEQ ID NO: 35301 - DNA, 23 bp, Artificial Sequence
  Synthetic Construct
gctgtgtccaggaaagtcaattc

SEQ ID NO: 35302 - DNA, 23 bp, Artificial Sequence
  Synthetic Construct
gggaaatgcctgtgcatccttca

SEQ ID NO: 35303 - DNA, 22 bp, Artificial Sequence
  Synthetic Construct
ggcagcagtgtcaagcttctgt

SEQ ID NO: 35304 - DNA, 21 bp, Artificial Sequence
  Synthetic Construct
gtccacccctcaacattgcat

SEQ ID NO: 35305 - DNA, 27 bp, Artificial Sequence
  Synthetic Construct
ggcccgaaatcaatactcacagagcta

SEQ ID NO: 35306 - DNA, 23 bp, Artificial Sequence
  Synthetic Construct
ccaggaaccatggcagagatgtt

SEQ ID NO: 35307 - DNA, 20 bp, Artificial Sequence
  Synthetic Construct
ggcttgcctggtgaagaaca

SEQ ID NO: 35308 - DNA, 22 bp, Artificial Sequence
  Synthetic Construct
gtgattcctggagagccaccaa

SEQ ID NO: 35309 - DNA, 20 bp, Artificial Sequence
  Synthetic Construct
actgcagagggcctggagat

SEQ ID NO: 35310 - DNA, 20 bp, Artificial Sequence
  Synthetic Construct
ctctcctgcttgtggcactt

SEQ ID NO: 35311 - DNA, 24 bp, Artificial Sequence
  Synthetic Construct
ggctctgtagcctcggatttccat

SEQ ID NO: 35312 - DNA, 20 bp, Artificial Sequence
  Synthetic Construct
tggtgcaatcctggctcaca

SEQ ID NO: 35313 - DNA, 21 bp, Artificial Sequence
  Synthetic Construct
gcactttgggaatgccagtga

SEQ ID NO: 35314 - DNA, 18 bp, Artificial Sequence
  Synthetic Construct
acctcccgcatggctaca

SEQ ID NO: 35315 - DNA, 20 bp, Artificial Sequence
  Synthetic Construct
ctccggtgccttgttgaact

SEQ ID NO: 35316 - DNA, 22 bp, Artificial Sequence
  Synthetic Construct
gtcatccccagttgtgttgaga

SEQ ID NO: 35317 - DNA, 19 bp, Artificial Sequence
  Synthetic Construct
tgcagcccagttccagagt

SEQ ID NO: 35318 - DNA, 25 bp, Artificial Sequence
  Synthetic Construct
gggttaaaactgtgactcggtgcat

SEQ ID NO: 35319 - DNA, 20 bp, Artificial Sequence
  Synthetic Construct
gcactcgtcaccgaacaagt

SEQ ID NO: 35320 - DNA, 20 bp, Artificial Sequence
  Synthetic Construct
actcccatccccatcacctt

SEQ ID NO: 35321 - DNA, 22 bp, Artificial Sequence
  Synthetic Construct
ggttaaccaagcgcaagtccta

SEQ ID NO: 35322 - DNA, 23 bp, Artificial Sequence
  Synthetic Construct
gggcattaagtctccctgccaat

SEQ ID NO: 35323 - DNA, 21 bp, Artificial Sequence
  Synthetic Construct
ggtgatgtgcctgtggtggat

SEQ ID NO: 35324 - DNA, 24 bp, Artificial Sequence
  Synthetic Construct
ggaaccatgatgagctgaagttct

SEQ ID NO: 35325 - DNA, 20 bp, Artificial Sequence
  Synthetic Construct
gccactgccctgaggctatc

SEQ ID NO: 35326 - DNA, 26 bp, Artificial Sequence
  Synthetic Construct
gctaatctgtggataactggctcata

SEQ ID NO: 35327 - DNA, 22 bp, Artificial Sequence
  Synthetic Construct
tccccttctccaggttggttag

SEQ ID NO: 35328 - DNA, 21 bp, Artificial Sequence
  Synthetic Construct
gcagggcaccaaaggcatact

SEQ ID NO: 35329 - DNA, 22 bp, Artificial Sequence
  Synthetic Construct
agctgctttagaggctgtcttc

SEQ ID NO: 35330 - DNA, 22 bp, Artificial Sequence
  Synthetic Construct
gagactcagacgtgagcaaaga

SEQ ID NO: 35331 - DNA, 24 bp, Artificial Sequence
  Synthetic Construct
ggtgctaggtcgtgttctctcttc

SEQ ID NO: 35332 - DNA, 24 bp, Artificial Sequence
  Synthetic Construct
cctagtgtttgatggccattcctt

SEQ ID NO: 35333 - DNA, 20 bp, Artificial Sequence
  Synthetic Construct
tcccttcccctaggtgcttt

SEQ ID NO: 35334 - DNA, 19 bp, Artificial Sequence
  Synthetic Construct
ccaaggctggcctcacaag

SEQ ID NO: 35335 - DNA, 20 bp, Artificial Sequence
  Synthetic Construct
gcaggtgtgaacggttgcat

SEQ ID NO: 35336 - DNA, 22 bp, Artificial Sequence
  Synthetic Construct
gttggacctgagactccaccat

SEQ ID NO: 35337 - DNA, 20 bp, Artificial Sequence
  Synthetic Construct
tttccagccttgggctcaga

SEQ ID NO: 35338 - DNA, 23 bp, Artificial Sequence
  Synthetic Construct
cgggaaggaggtcccaagttaca

SEQ ID NO: 35339 - DNA, 20 bp, Artificial Sequence
  Synthetic Construct
tccagaggggtcatccacaa

SEQ ID NO: 35340 - DNA, 20 bp, Artificial Sequence
  Synthetic Construct
aggaccagggcccacaccat

SEQ ID NO: 35341 - DNA, 22 bp, Artificial Sequence
  Synthetic Construct
gaccgtgccttcctgatttaca

SEQ ID NO: 35342 - DNA, 22 bp, Artificial Sequence
  Synthetic Construct
tttccctccactgtagctcaac

SEQ ID NO: 35343 - DNA, 20 bp, Artificial Sequence
  Synthetic Construct
accacagggtgatgcagagt

SEQ ID NO: 35344 - DNA, 20 bp, Artificial Sequence
  Synthetic Construct
acaaccgagcaggtcaggaa

SEQ ID NO: 35345 - DNA, 24 bp, Artificial Sequence
  Synthetic Construct
cccaagcttgtaagtggaacagta

SEQ ID NO: 35346 - DNA, 20 bp, Artificial Sequence
  Synthetic Construct
atgcccggccagtcctttat

SEQ ID NO: 35347 - DNA, 22 bp, Artificial Sequence
  Synthetic Construct
gcagctagcaatgacctagcaa

SEQ ID NO: 35348 - DNA, 21 bp, Artificial Sequence
  Synthetic Construct
aactccaggggtgccttccaa

SEQ ID NO: 35349 - DNA, 25 bp, Artificial Sequence
  Synthetic Construct
ggaagacccggatgaacaaacaaag

SEQ ID NO: 35350 - DNA, 27 bp, Artificial Sequence
  Synthetic Construct
cccctgttctatttacaggaccccttt

SEQ ID NO: 35351 - DNA, 24 bp, Artificial Sequence
  Synthetic Construct
cagcaccaggatgtctcagattac

SEQ ID NO: 35352 - DNA, 20 bp, Artificial Sequence
  Synthetic Construct
tgggagcccagcctgctaga

SEQ ID NO: 35353 - DNA, 20 bp, Artificial Sequence
  Synthetic Construct
agggccctggccttaggatt

SEQ ID NO: 35354 - DNA, 19 bp, Artificial Sequence
  Synthetic Construct
ttcaatgccagcccacgaa

SEQ ID NO: 35355 - DNA, 23 bp, Artificial Sequence
  Synthetic Construct
gcctcttccccatcctcacttct

SEQ ID NO: 35356 - DNA, 24 bp, Artificial Sequence
  Synthetic Construct
ccactgggcaattgaagagaggaa

SEQ ID NO: 35357 - DNA, 23 bp, Artificial Sequence
  Synthetic Construct
tcccttactggggtgggagtagt

SEQ ID NO: 35358 - DNA, 19 bp, Artificial Sequence
  Synthetic Construct
agtgggccggagtcaggta

SEQ ID NO: 35359 - DNA, 20 bp, Artificial Sequence
  Synthetic Construct
agagttaggcaggccccaaa

SEQ ID NO: 35360 - DNA, 22 bp, Artificial Sequence
  Synthetic Construct
cagccttccaggccaagtatgt

SEQ ID NO: 35361 - DNA, 21 bp, Artificial Sequence
  Synthetic Construct
tctccagcacaccctctccat

SEQ ID NO: 35362 - DNA, 22 bp, Artificial Sequence
  Synthetic Construct
tggggtcgaaaggggttgtaag

SEQ ID NO: 35363 - DNA, 21 bp, Artificial Sequence
  Synthetic Construct
ccaagggacaggaccatctct

SEQ ID NO: 35364 - DNA, 20 bp, Artificial Sequence
  Synthetic Construct
tgctcctccctgcaacaaac

SEQ ID NO: 35365 - DNA, 23 bp, Artificial Sequence
  Synthetic Construct
cagcctttgcttctgagggtttc

SEQ ID NO: 35366 - DNA, 26 bp, Artificial Sequence
  Synthetic Construct
gcaagcaatgcacaaagaaaggaaag

SEQ ID NO: 35367 - DNA, 27 bp, Artificial Sequence
  Synthetic Construct
gacctaactttatgtcacttgctgttg

SEQ ID NO: 35368 - DNA, 27 bp, Artificial Sequence
  Synthetic Construct
cctgttgaaaggcatttctcacctgaa

SEQ ID NO: 35369 - DNA, 20 bp, Artificial Sequence
  Synthetic Construct
tctcacagccaagcccaaca

SEQ ID NO: 35370 - DNA, 18 bp, Artificial Sequence
  Synthetic Construct
agacagcacgggccactt

SEQ ID NO: 35371 - DNA, 23 bp, Artificial Sequence
  Synthetic Construct
tgaaaacttggtggcaacacttg

SEQ ID NO: 35372 - DNA, 22 bp, Artificial Sequence
  Synthetic Construct
gcctgccccagcttttcttcta

SEQ ID NO: 35373 - DNA, 18 bp, Artificial Sequence
  Synthetic Construct
tgaggagcctgcctgcaa

SEQ ID NO: 35374 - DNA, 25 bp, Artificial Sequence
  Synthetic Construct
gctcactacttaaggggatgtcagt

SEQ ID NO: 35375 - DNA, 24 bp, Artificial Sequence
  Synthetic Construct
ctgtgttgaatgagtagggtggaa

SEQ ID NO: 35376 - DNA, 23 bp, Artificial Sequence
  Synthetic Construct
cccaggctgaaattgctttccta

SEQ ID NO: 35377 - DNA, 23 bp, Artificial Sequence
  Synthetic Construct
ggcagagactagggttccaggtt

SEQ ID NO: 35378 - DNA, 19 bp, Artificial Sequence
  Synthetic Construct
acggctcgcttgctgactt

SEQ ID NO: 35379 - DNA, 21 bp, Artificial Sequence
  Synthetic Construct
atccccagcccatcagcaagt

SEQ ID NO: 35380 - DNA, 20 bp, Artificial Sequence
  Synthetic Construct
agctctccttccctgtgtgt

SEQ ID NO: 35381 - DNA, 20 bp, Artificial Sequence
  Synthetic Construct
acagactcgggttggctgtt

SEQ ID NO: 35382 - DNA, 21 bp, Artificial Sequence
  Synthetic Construct
tgtcccctcaggccttctgta

SEQ ID NO: 35383 - DNA, 19 bp, Artificial Sequence
  Synthetic Construct
tccggaggtgcaggttttg

SEQ ID NO: 35384 - DNA, 24 bp, Artificial Sequence
  Synthetic Construct
ctgggtagtaaaagcggtgtttga

SEQ ID NO: 35385 - DNA, 25 bp, Artificial Sequence
  Synthetic Construct
gcagctacacttgcctctaggagaa

SEQ ID NO: 35386 - DNA, 21 bp, Artificial Sequence
  Synthetic Construct
tcctgcccctttccttctagt

SEQ ID NO: 35387 - DNA, 19 bp, Artificial Sequence
  Synthetic Construct
aaccagctgcgccccaaca

SEQ ID NO: 35388 - DNA, 30 bp, Artificial Sequence
  Synthetic Construct
ggtcttgttaccataatgtgagtcttcact

SEQ ID NO: 35389 - DNA, 20 bp, Artificial Sequence
  Synthetic Construct
tttggcaggaagccccaaag

SEQ ID NO: 35390 - DNA, 23 bp, Artificial Sequence
  Synthetic Construct
gctgagtttcagtcggactctgt

SEQ ID NO: 35391 - DNA, 27 bp, Artificial Sequence
  Synthetic Construct
gaggatgtgagcaggaacttactaatg

SEQ ID NO: 35392 - DNA, 21 bp, Artificial Sequence
  Synthetic Construct
taagaggagggcggtgggaat

SEQ ID NO: 35393 - DNA, 25 bp, Artificial Sequence
  Synthetic Construct
gtgtgctgcttgcagatgtatcttt

SEQ ID NO: 35394 - DNA, 23 bp, Artificial Sequence
  Synthetic Construct
ctgtagtgccaaaaggacggttt

SEQ ID NO: 35395 - DNA, 20 bp, Artificial Sequence
  Synthetic Construct
gccttccctgagatggcaaa

SEQ ID NO: 35396 - DNA, 21 bp, Artificial Sequence
  Synthetic Construct
ggctcagaaatgcagggctat

SEQ ID NO: 35397 - DNA, 21 bp, Artificial Sequence
  Synthetic Construct
gcgcaggccatttttctgctt

SEQ ID NO: 35398 - DNA, 22 bp, Artificial Sequence
  Synthetic Construct
ggcaaagcatcgctgaggaagt

SEQ ID NO: 35399 - DNA, 23 bp, Artificial Sequence
  Synthetic Construct
gctgtcacattccaccagacctt

SEQ ID NO: 35400 - DNA, 24 bp, Artificial Sequence
  Synthetic Construct
ccccatacagtcttagggaacaga

SEQ ID NO: 35401 - DNA, 25 bp, Artificial Sequence
  Synthetic Construct
ctcattcaccatttctccccagttg

SEQ ID NO: 35402 - DNA, 20 bp, Artificial Sequence
  Synthetic Construct
tggtgggactgtgctgttac

SEQ ID NO: 35403 - DNA, 24 bp, Artificial Sequence
  Synthetic Construct
caccatcatgccagggataagttc

SEQ ID NO: 35404 - DNA, 27 bp, Artificial Sequence
  Synthetic Construct
tccacctactttctcaaactctacttc

SEQ ID NO: 35405 - DNA, 23 bp, Artificial Sequence
  Synthetic Construct
tgcacactttgcttccatctgta

SEQ ID NO: 35406 - DNA, 20 bp, Artificial Sequence
  Synthetic Construct
agaagcacaggaggccaatc

SEQ ID NO: 35407 - DNA, 23 bp, Artificial Sequence
  Synthetic Construct
cctgcatgcactggaaaggatga

SEQ ID NO: 35408 - DNA, 19 bp, Artificial Sequence
  Synthetic Construct
gggagggtccacagtcaca

SEQ ID NO: 35409 - DNA, 25 bp, Artificial Sequence
  Synthetic Construct
ctggttttgaagggagcccttatct

SEQ ID NO: 35410 - DNA, 20 bp, Artificial Sequence
  Synthetic Construct
aacccaccctcactgcatct

SEQ ID NO: 35411 - DNA, 28 bp, Artificial Sequence
  Synthetic Construct
ggcagagaggaataaagacccatcattg

SEQ ID NO: 35412 - DNA, 22 bp, Artificial Sequence
  Synthetic Construct
ccttcctaccctagagccacat

SEQ ID NO: 35413 - DNA, 25 bp, Artificial Sequence
  Synthetic Construct
ggttccagagacccaagtcgaagtt

SEQ ID NO: 35414 - DNA, 27 bp, Artificial Sequence
  Synthetic Construct
cctttagttcaccctgtccttcctaag

SEQ ID NO: 35415 - DNA, 20 bp, Artificial Sequence
  Synthetic Construct
tcctgacctctggcctgtct

SEQ ID NO: 35416 - DNA, 20 bp, Artificial Sequence
  Synthetic Construct
gtgttggcggagatgcagaa

SEQ ID NO: 35417 - DNA, 21 bp, Artificial Sequence
  Synthetic Construct
ctcgagtttgccagcaacaga

SEQ ID NO: 35418 - DNA, 22 bp, Artificial Sequence
  Synthetic Construct
cccctaatgcctcgcagttctt

SEQ ID NO: 35419 - DNA, 18 bp, Artificial Sequence
  Synthetic Construct
aggctagagcgcggcaaa

SEQ ID NO: 35420 - DNA, 22 bp, Artificial Sequence
  Synthetic Construct
agtcctgagagggtcagctatc

SEQ ID NO: 35421 - DNA, 21 bp, Artificial Sequence
  Synthetic Construct
tagctgtggctccctcctact

SEQ ID NO: 35422 - DNA, 20 bp, Artificial Sequence
  Synthetic Construct
atcctcaccccagcctcttc

SEQ ID NO: 35423 - DNA, 23 bp, Artificial Sequence
  Synthetic Construct
gtgaaggaaacagcatggcaaca

SEQ ID NO: 35424 - DNA, 18 bp, Artificial Sequence
  Synthetic Construct
agcctctggaggcagcat

SEQ ID NO: 35425 - DNA, 19 bp, Artificial Sequence
  Synthetic Construct
aagcctccccgcctcttct

SEQ ID NO: 35426 - DNA, 25 bp, Artificial Sequence
  Synthetic Construct
ccgccctgaagagaagaacacaaac

SEQ ID NO: 35427 - DNA, 20 bp, Artificial Sequence
  Synthetic Construct
aggcatggcagcagtgtgta

SEQ ID NO: 35428 - DNA, 29 bp, Artificial Sequence
  Synthetic Construct
gcatgtaacttaccgtactgtgactgttt

SEQ ID NO: 35429 - DNA, 20 bp, Artificial Sequence
  Synthetic Construct
aagcagggtctgtgctgaca

SEQ ID NO: 35430 - DNA, 19 bp, Artificial Sequence
  Synthetic Construct
tcgagtcgcgggaagctaa

SEQ ID NO: 35431 - DNA, 23 bp, Artificial Sequence
  Synthetic Construct
cactgatagcaaggggtggaatc

SEQ ID NO: 35432 - DNA, 24 bp, Artificial Sequence
  Synthetic Construct
gaggagatggaggccttaacatac

SEQ ID NO: 35433 - DNA, 21 bp, Artificial Sequence
  Synthetic Construct
ttccccttgccaggaggttgt

SEQ ID NO: 35434 - DNA, 22 bp, Artificial Sequence
  Synthetic Construct
ctgccttcatcaggccctactt

SEQ ID NO: 35435 - DNA, 19 bp, Artificial Sequence
  Synthetic Construct
tcgctgtgacgcgggtaag

SEQ ID NO: 35436 - DNA, 19 bp, Artificial Sequence
  Synthetic Construct
aagtggcgtggccttggaa

SEQ ID NO: 35437 - DNA, 23 bp, Artificial Sequence
  Synthetic Construct
gggcacaagcgatttccaatcaa

SEQ ID NO: 35438 - DNA, 22 bp, Artificial Sequence
  Synthetic Construct
cagtgggattccagacggcata

SEQ ID NO: 35439 - DNA, 26 bp, Artificial Sequence
  Synthetic Construct
gggctgctttacctctaatgccaagt

SEQ ID NO: 35440 - DNA, 26 bp, Artificial Sequence
  Synthetic Construct
cgaatctaagacaacactccgacgta

SEQ ID NO: 35441 - DNA, 22 bp, Artificial Sequence
  Synthetic Construct
gaggtgagggaatgagctgtgt

SEQ ID NO: 35442 - DNA, 23 bp, Artificial Sequence
  Synthetic Construct
cctgaacaccacagccttagaga

SEQ ID NO: 35443 - DNA, 22 bp, Artificial Sequence
  Synthetic Construct
ggaaggaagggctatgctctgt

SEQ ID NO: 35444 - DNA, 24 bp, Artificial Sequence
  Synthetic Construct
gcacctgacaggaaatacgactca

SEQ ID NO: 35445 - DNA, 27 bp, Artificial Sequence
  Synthetic Construct
cacttatcagcaggtactatgctccaa

SEQ ID NO: 35446 - DNA, 21 bp, Artificial Sequence
  Synthetic Construct
tcaccatggctgctgggattg

SEQ ID NO: 35447 - DNA, 27 bp, Artificial Sequence
  Synthetic Construct
gctctcacttattggaactggtggatt

SEQ ID NO: 35448 - DNA, 24 bp, Artificial Sequence
  Synthetic Construct
cccagaatgttcccaggtgtgttc

SEQ ID NO: 35449 - DNA, 24 bp, Artificial Sequence
  Synthetic Construct
ctcatgctaatcctctgccctttt

SEQ ID NO: 35450 - DNA, 20 bp, Artificial Sequence
  Synthetic Construct
acggccagtgtcttcaggtt

SEQ ID NO: 35451 - DNA, 23 bp, Artificial Sequence
  Synthetic Construct
ccaagttgggaaagctggtgttg

SEQ ID NO: 35452 - DNA, 24 bp, Artificial Sequence
  Synthetic Construct
ccatgttgctgagagcttgggtta

SEQ ID NO: 35453 - DNA, 27 bp, Artificial Sequence
  Synthetic Construct
tctatgagactctggaactgtcttttg

SEQ ID NO: 35454 - DNA, 25 bp, Artificial Sequence
  Synthetic Construct
cagagaggaaaggactgtgtacttg

SEQ ID NO: 35455 - DNA, 24 bp, Artificial Sequence
  Synthetic Construct
ctggaagcatcaagaaaggcttca

SEQ ID NO: 35456 - DNA, 21 bp, Artificial Sequence
  Synthetic Construct
cccaagttgaggacagctgaa

SEQ ID NO: 35457 - DNA, 19 bp, Artificial Sequence
  Synthetic Construct
agcagggcagggcagtgaa

SEQ ID NO: 35458 - DNA, 21 bp, Artificial Sequence
  Synthetic Construct
tcatctcggcccagtgagaga

SEQ ID NO: 35459 - DNA, 23 bp, Artificial Sequence
  Synthetic Construct
tgaacaacgtagcaacactggat

SEQ ID NO: 35460 - DNA, 21 bp, Artificial Sequence
  Synthetic Construct
gcaaaggcttgtggtcgagaa

SEQ ID NO: 35461 - DNA, 25 bp, Artificial Sequence
  Synthetic Construct
gctacaagggtaaaaccaggaccaa

SEQ ID NO: 35462 - DNA, 20 bp, Artificial Sequence
  Synthetic Construct
tgccatttggccagcctttc

SEQ ID NO: 35463 - DNA, 20 bp, Artificial Sequence
  Synthetic Construct
agagctctggcacctgtttg

SEQ ID NO: 35464 - DNA, 24 bp, Artificial Sequence
  Synthetic Construct
gctcccagacgtcattggatctgt

SEQ ID NO: 35465 - DNA, 23 bp, Artificial Sequence
  Synthetic Construct
ccctggaacttctgaccgcattt

SEQ ID NO: 35466 - DNA, 25 bp, Artificial Sequence
  Synthetic Construct
gctaagcatcccagaaacccaaatg

SEQ ID NO: 35467 - DNA, 20 bp, Artificial Sequence
  Synthetic Construct
accccgtgcagctggtcact

SEQ ID NO: 35468 - DNA, 24 bp, Artificial Sequence
  Synthetic Construct
ggccctccctgaggaagtaaaatg

SEQ ID NO: 35469 - DNA, 20 bp, Artificial Sequence
  Synthetic Construct
ttctgggcagcatccagttg

SEQ ID NO: 35470 - DNA, 21 bp, Artificial Sequence
  Synthetic Construct
ccaggttcgaggcactgactt

SEQ ID NO: 35471 - DNA, 21 bp, Artificial Sequence
  Synthetic Construct
gtgctttggcttcctcgaatc

SEQ ID NO: 35472 - DNA, 20 bp, Artificial Sequence
  Synthetic Construct
tccttgcaggtggtgacctt

SEQ ID NO: 35473 - DNA, 21 bp, Artificial Sequence
  Synthetic Construct
ggtgtgcgtgcattagcaaac

SEQ ID NO: 35474 - DNA, 29 bp, Artificial Sequence
  Synthetic Construct
ggacaatgacctttagagagaaggaatct

SEQ ID NO: 35475 - DNA, 21 bp, Artificial Sequence
  Synthetic Construct
gactcaggtatcccggtctct

SEQ ID NO: 35476 - DNA, 26 bp, Artificial Sequence
  Synthetic Construct
cctccttgcctctaaagctcttggtt

SEQ ID NO: 35477 - DNA, 22 bp, Artificial Sequence
  Synthetic Construct
gcccacagaactctgggagatt

SEQ ID NO: 35478 - DNA, 22 bp, Artificial Sequence
  Synthetic Construct
tgaacagaagagctccatgcaa

SEQ ID NO: 35479 - DNA, 22 bp, Artificial Sequence
  Synthetic Construct
gggctggcttcccaaagtgatt

SEQ ID NO: 35480 - DNA, 21 bp, Artificial Sequence
  Synthetic Construct
tctctctagcctggggctttg

SEQ ID NO: 35481 - DNA, 22 bp, Artificial Sequence
  Synthetic Construct
ggagcatactgtgtggggagaa

SEQ ID NO: 35482 - DNA, 20 bp, Artificial Sequence
  Synthetic Construct
agtcggggctgcaggactaa

SEQ ID NO: 35483 - DNA, 21 bp, Artificial Sequence
  Synthetic Construct
cctcaaagccggtgcatctct

SEQ ID NO: 35484 - DNA, 19 bp, Artificial Sequence
  Synthetic Construct
tcgcacctccggtcacttg

SEQ ID NO: 35485 - DNA, 20 bp, Artificial Sequence
  Synthetic Construct
tgcgtctgcctacgcatgtt

SEQ ID NO: 35486 - DNA, 24 bp, Artificial Sequence
  Synthetic Construct
agtcagatgcagaataggctgatg

SEQ ID NO: 35487 - DNA, 20 bp, Artificial Sequence
  Synthetic Construct
agaaggcgacctccccaaat

SEQ ID NO: 35488 - DNA, 23 bp, Artificial Sequence
  Synthetic Construct
cctcccagcctctctacctcttt

SEQ ID NO: 35489 - DNA, 26 bp, Artificial Sequence
  Synthetic Construct
catgtgttgaccctaaacttgacaac

SEQ ID NO: 35490 - DNA, 21 bp, Artificial Sequence
  Synthetic Construct
gcctccctttggcccattttg

SEQ ID NO: 35491 - DNA, 22 bp, Artificial Sequence
  Synthetic Construct
caggccttgcctaactcagatg

SEQ ID NO: 35492 - DNA, 25 bp, Artificial Sequence
  Synthetic Construct
gggttgttcactccattcacagcta

SEQ ID NO: 35493 - DNA, 20 bp, Artificial Sequence
  Synthetic Construct
cagcagtgcacacagcacta

SEQ ID NO: 35494 - DNA, 20 bp, Artificial Sequence
  Synthetic Construct
gccattggtgctgcatgtct

SEQ ID NO: 35495 - DNA, 20 bp, Artificial Sequence
  Synthetic Construct
ttccgcttccctgccaagat

SEQ ID NO: 35496 - DNA, 23 bp, Artificial Sequence
  Synthetic Construct
ctcactctgggactatgcgagat

SEQ ID NO: 35497 - DNA, 23 bp, Artificial Sequence
  Synthetic Construct
cccttttcatggacagaggacat

SEQ ID NO: 35498 - DNA, 19 bp, Artificial Sequence
  Synthetic Construct
tcttgccagttgccgttga

SEQ ID NO: 35499 - DNA, 21 bp, Artificial Sequence
  Synthetic Construct
tgccggaacagcaggatgact

SEQ ID NO: 35500 - DNA, 27 bp, Artificial Sequence
  Synthetic Construct
gagagttctgtacctgtgtgtatcttc

SEQ ID NO: 35501 - DNA, 18 bp, Artificial Sequence
  Synthetic Construct
atggccagggcagtgcat

SEQ ID NO: 35502 - DNA, 22 bp, Artificial Sequence
  Synthetic Construct
tggctctcccttgggcagtaag

SEQ ID NO: 35503 - DNA, 24 bp, Artificial Sequence
  Synthetic Construct
ggggcattaaagctagtggaaaac

SEQ ID NO: 35504 - DNA, 21 bp, Artificial Sequence
  Synthetic Construct
ccctatgtgctgacggaggta

SEQ ID NO: 35505 - DNA, 26 bp, Artificial Sequence
  Synthetic Construct
gtctgcctatcatttgtgtagtggaa

SEQ ID NO: 35506 - DNA, 20 bp, Artificial Sequence
  Synthetic Construct
gcaaggtggccattctgaca

SEQ ID NO: 35507 - DNA, 22 bp, Artificial Sequence
  Synthetic Construct
ttgatcagggtcttggctcttc

SEQ ID NO: 35508 - DNA, 21 bp, Artificial Sequence
  Synthetic Construct
gaagcccaagggttgagttga

SEQ ID NO: 35509 - DNA, 19 bp, Artificial Sequence
  Synthetic Construct
ggggacctgggagaccatt

SEQ ID NO: 35510 - DNA, 20 bp, Artificial Sequence
  Synthetic Construct
ccctctcagcctccctcctt

SEQ ID NO: 35511 - DNA, 22 bp, Artificial Sequence
  Synthetic Construct
cagtccagagagtgggcatttg

SEQ ID NO: 35512 - DNA, 24 bp, Artificial Sequence
  Synthetic Construct
ttccaggcatcacctgaagataag

SEQ ID NO: 35513 - DNA, 24 bp, Artificial Sequence
  Synthetic Construct
ccctctgtaccctgaggacaaaca

SEQ ID NO: 35514 - DNA, 24 bp, Artificial Sequence
  Synthetic Construct
gggccttgtgtagacaacctggaa

SEQ ID NO: 35515 - DNA, 24 bp, Artificial Sequence
  Synthetic Construct
gcgatgcacagtgctttctcaaac

SEQ ID NO: 35516 - DNA, 20 bp, Artificial Sequence
  Synthetic Construct
tcgcacgtggacccaactaa

SEQ ID NO: 35517 - DNA, 28 bp, Artificial Sequence
  Synthetic Construct
ggttcctgaaaggtttaaagaccgtgaa

SEQ ID NO: 35518 - DNA, 25 bp, Artificial Sequence
  Synthetic Construct
gtgatcctgtgaactttgtgcctaa

SEQ ID NO: 35519 - DNA, 23 bp, Artificial Sequence
  Synthetic Construct
ggtgcatgaaagggacagagcat

SEQ ID NO: 35520 - DNA, 22 bp, Artificial Sequence
  Synthetic Construct
actgcctgaatctctggagtct

SEQ ID NO: 35521 - DNA, 19 bp, Artificial Sequence
  Synthetic Construct
tgggctggagtgcaccatt

SEQ ID NO: 35522 - DNA, 22 bp, Artificial Sequence
  Synthetic Construct
cctggcctcataacgtccattc

SEQ ID NO: 35523 - DNA, 21 bp, Artificial Sequence
  Synthetic Construct
cccctttcccttcgcacttct

SEQ ID NO: 35524 - DNA, 26 bp, Artificial Sequence
  Synthetic Construct
ggaagaaaagatctgggagggtggtt

SEQ ID NO: 35525 - DNA, 23 bp, Artificial Sequence
  Synthetic Construct
caaacacagatctgcctctggat

SEQ ID NO: 35526 - DNA, 26 bp, Artificial Sequence
  Synthetic Construct
gggctattttagaagcagaaggatga

SEQ ID NO: 35527 - DNA, 26 bp, Artificial Sequence
  Synthetic Construct
cacactcgacatcaactgagactaga

SEQ ID NO: 35528 - DNA, 21 bp, Artificial Sequence
  Synthetic Construct
gcagctacaagccttcacact

SEQ ID NO: 35529 - DNA, 21 bp, Artificial Sequence
  Synthetic Construct
gcttgggcttcctcacagcat

SEQ ID NO: 35530 - DNA, 21 bp, Artificial Sequence
  Synthetic Construct
tagggagtgggatggggacaa

SEQ ID NO: 35531 - DNA, 22 bp, Artificial Sequence
  Synthetic Construct
gaccagagaacccttgcgattc

SEQ ID NO: 35532 - DNA, 22 bp, Artificial Sequence
  Synthetic Construct
agtaggtgtacccaccttgtct

SEQ ID NO: 35533 - DNA, 25 bp, Artificial Sequence
  Synthetic Construct
tccttctgtatgatcaacggacttg

SEQ ID NO: 35534 - DNA, 20 bp, Artificial Sequence
  Synthetic Construct
tcacaaggcagtggggaatg

SEQ ID NO: 35535 - DNA, 19 bp, Artificial Sequence
  Synthetic Construct
gcggcttggtgaccgtgat

SEQ ID NO: 35536 - DNA, 24 bp, Artificial Sequence
  Synthetic Construct
ggatgttgtttctaggctgtgatg

SEQ ID NO: 35537 - DNA, 24 bp, Artificial Sequence
  Synthetic Construct
gagagagaatgccagacagttttg

SEQ ID NO: 35538 - DNA, 19 bp, Artificial Sequence
  Synthetic Construct
gccgagtccagcccaatca

SEQ ID NO: 35539 - DNA, 19 bp, Artificial Sequence
  Synthetic Construct
accccaggagccagtctgt

SEQ ID NO: 35540 - DNA, 24 bp, Artificial Sequence
  Synthetic Construct
tgcccagctgttattaggtgttac

SEQ ID NO: 35541 - DNA, 22 bp, Artificial Sequence
  Synthetic Construct
tgcctcagagacttgggctgta

SEQ ID NO: 35542 - DNA, 27 bp, Artificial Sequence
  Synthetic Construct
gacatgcctatttgacccaaattctgt

SEQ ID NO: 35543 - DNA, 24 bp, Artificial Sequence
  Synthetic Construct
gcagtgctaacagtttggcagatg

SEQ ID NO: 35544 - DNA, 19 bp, Artificial Sequence
  Synthetic Construct
cgggcatgtggggttgaca

SEQ ID NO: 35545 - DNA, 21 bp, Artificial Sequence
  Synthetic Construct
tgtgcctcgtctcatctcact

SEQ ID NO: 35546 - DNA, 27 bp, Artificial Sequence
  Synthetic Construct
cactgattaatatccacaggccagctt

SEQ ID NO: 35547 - DNA, 29 bp, Artificial Sequence
  Synthetic Construct
ccgaaggataatgtaggaggtgagagatg

SEQ ID NO: 35548 - DNA, 22 bp, Artificial Sequence
  Synthetic Construct
gctgatcccaggctcacttttg

SEQ ID NO: 35549 - DNA, 22 bp, Artificial Sequence
  Synthetic Construct
agggaactggctcagctggtat

SEQ ID NO: 35550 - DNA, 22 bp, Artificial Sequence
  Synthetic Construct
gtggagcaaaacccctctcact

SEQ ID NO: 35551 - DNA, 20 bp, Artificial Sequence
  Synthetic Construct
aaacacccctccccacaaag

SEQ ID NO: 35552 - DNA, 27 bp, Artificial Sequence
  Synthetic Construct
ggtggctctccagagattttagacaga

SEQ ID NO: 35553 - DNA, 21 bp, Artificial Sequence
  Synthetic Construct
ccacttcccggctgtgttctt

SEQ ID NO: 35554 - DNA, 19 bp, Artificial Sequence
  Synthetic Construct
agaccaccggggaccttga

SEQ ID NO: 35555 - DNA, 24 bp, Artificial Sequence
  Synthetic Construct
gggctagacacaggatgagtttct

SEQ ID NO: 35556 - DNA, 22 bp, Artificial Sequence
  Synthetic Construct
gggccctgtgaaaagagactga

SEQ ID NO: 35557 - DNA, 19 bp, Artificial Sequence
  Synthetic Construct
ccagcagctgaggcagaga

SEQ ID NO: 35558 - DNA, 23 bp, Artificial Sequence
  Synthetic Construct
ggtgacctacagcaaggcactac

SEQ ID NO: 35559 - DNA, 22 bp, Artificial Sequence
  Synthetic Construct
ggggtgcgtgtgttggatttca

SEQ ID NO: 35560 - DNA, 25 bp, Artificial Sequence
  Synthetic Construct
acgagatccaggactacatttctca

SEQ ID NO: 35561 - DNA, 24 bp, Artificial Sequence
  Synthetic Construct
gtcagcttcagctcccaattccta

SEQ ID NO: 35562 - DNA, 23 bp, Artificial Sequence
  Synthetic Construct
cttttccatgaagggagcaggaa

SEQ ID NO: 35563 - DNA, 22 bp, Artificial Sequence
  Synthetic Construct
actcgcaaaatgggtggctatc

SEQ ID NO: 35564 - DNA, 20 bp, Artificial Sequence
  Synthetic Construct
aaatgggcatggggcagagt

SEQ ID NO: 35565 - DNA, 22 bp, Artificial Sequence
  Synthetic Construct
gtggtacccttagtccccaaga

SEQ ID NO: 35566 - DNA, 22 bp, Artificial Sequence
  Synthetic Construct
ggtgctgtgctggcactaaaag

SEQ ID NO: 35567 - DNA, 21 bp, Artificial Sequence
  Synthetic Construct
tgtggccagaccaggcatact

SEQ ID NO: 35568 - DNA, 21 bp, Artificial Sequence
  Synthetic Construct
tccctgaagcagagagcttgt

SEQ ID NO: 35569 - DNA, 24 bp, Artificial Sequence
  Synthetic Construct
ctgcatgtaaatcagggcatccaa

SEQ ID NO: 35570 - DNA, 20 bp, Artificial Sequence
  Synthetic Construct
ggaattgggtccgtccatgt

SEQ ID NO: 35571 - DNA, 24 bp, Artificial Sequence
  Synthetic Construct
gctagagaggctgtccctagttgt

SEQ ID NO: 35572 - DNA, 26 bp, Artificial Sequence
  Synthetic Construct
cacaacctatgaggttaggtggcata

SEQ ID NO: 35573 - DNA, 21 bp, Artificial Sequence
  Synthetic Construct
ggccagtgtgacagcccttta

SEQ ID NO: 35574 - DNA, 20 bp, Artificial Sequence
  Synthetic Construct
atgggcaacaggtggtctga

SEQ ID NO: 35575 - DNA, 25 bp, Artificial Sequence
  Synthetic Construct
cttctccctcatttggcattttgtt

SEQ ID NO: 35576 - DNA, 23 bp, Artificial Sequence
  Synthetic Construct
tgaagacaaaactgtgggactgt

SEQ ID NO: 35577 - DNA, 24 bp, Artificial Sequence
  Synthetic Construct
cagggtaggaacagtgagaagaga

SEQ ID NO: 35578 - DNA, 20 bp, Artificial Sequence
  Synthetic Construct
tcccactgtcaccacagtca

SEQ ID NO: 35579 - DNA, 22 bp, Artificial Sequence
  Synthetic Construct
ttctgcaggtagcagtttgtga

SEQ ID NO: 35580 - DNA, 22 bp, Artificial Sequence
  Synthetic Construct
gggttctcaggcgagtagatgt

SEQ ID NO: 35581 - DNA, 26 bp, Artificial Sequence
  Synthetic Construct
ggcttattcaagggtttcagcagcat

SEQ ID NO: 35582 - DNA, 20 bp, Artificial Sequence
  Synthetic Construct
tggtgagcaggcctggttgt

SEQ ID NO: 35583 - DNA, 19 bp, Artificial Sequence
  Synthetic Construct
acaccatggcgtggattgt

SEQ ID NO: 35584 - DNA, 20 bp, Artificial Sequence
  Synthetic Construct
ggtcttggtgctggcctgtt

SEQ ID NO: 35585 - DNA, 21 bp, Artificial Sequence
  Synthetic Construct
tccctggaggggtgaggtcat

SEQ ID NO: 35586 - DNA, 21 bp, Artificial Sequence
  Synthetic Construct
aggaggaagacggcctcattg

SEQ ID NO: 35587 - DNA, 20 bp, Artificial Sequence
  Synthetic Construct
aggagtccggaggagcagat

SEQ ID NO: 35588 - DNA, 20 bp, Artificial Sequence
  Synthetic Construct
atcggggtgcctcacccatt

SEQ ID NO: 35589 - DNA, 24 bp, Artificial Sequence
  Synthetic Construct
gtcgttgaaaactggagtcaggaa

SEQ ID NO: 35590 - DNA, 20 bp, Artificial Sequence
  Synthetic Construct
actccagctggtgggagact

SEQ ID NO: 35591 - DNA, 21 bp, Artificial Sequence
  Synthetic Construct
gacctctgctacaggcaaact

SEQ ID NO: 35592 - DNA, 24 bp, Artificial Sequence
  Synthetic Construct
cctagacctgttagggcaatgtgt

SEQ ID NO: 35593 - DNA, 20 bp, Artificial Sequence
  Synthetic Construct
accattggctgggcctttga

SEQ ID NO: 35594 - DNA, 20 bp, Artificial Sequence
  Synthetic Construct
ttgccaactggcctcgcaat

SEQ ID NO: 35595 - DNA, 19 bp, Artificial Sequence
  Synthetic Construct
aaggtgctgggagcaggaa

SEQ ID NO: 35596 - DNA, 22 bp, Artificial Sequence
  Synthetic Construct
tgcagtaagacaggagccatga

SEQ ID NO: 35597 - DNA, 24 bp, Artificial Sequence
  Synthetic Construct
gcttccctcagaacagaaaagcaa

SEQ ID NO: 35598 - DNA, 20 bp, Artificial Sequence
  Synthetic Construct
ccaagctgtgggcagtgatg

SEQ ID NO: 35599 - DNA, 21 bp, Artificial Sequence
  Synthetic Construct
tggtcaacaagcctggagatg

SEQ ID NO: 35600 - DNA, 23 bp, Artificial Sequence
  Synthetic Construct
caggattgtgattcctggctttg

SEQ ID NO: 35601 - DNA, 29 bp, Artificial Sequence
  Synthetic Construct
cgagattaagaatgatccaggtgactgtt

SEQ ID NO: 35602 - DNA, 23 bp, Artificial Sequence
  Synthetic Construct
ccagtaagctgaaccgggacttc

SEQ ID NO: 35603 - DNA, 24 bp, Artificial Sequence
  Synthetic Construct
ggcattctctgcaaacaggtgcta

SEQ ID NO: 35604 - DNA, 20 bp, Artificial Sequence
  Synthetic Construct
acagtgccaccacctcagtt

SEQ ID NO: 35605 - DNA, 19 bp, Artificial Sequence
  Synthetic Construct
tgccggccttctccttgtt

SEQ ID NO: 35606 - DNA, 22 bp, Artificial Sequence
  Synthetic Construct
tgtcttgctctgtcctggtctt

SEQ ID NO: 35607 - DNA, 19 bp, Artificial Sequence
  Synthetic Construct
agagcggcgctacctcatt

SEQ ID NO: 35608 - DNA, 23 bp, Artificial Sequence
  Synthetic Construct
gcctaaaggtctgggaggaggaa

SEQ ID NO: 35609 - DNA, 22 bp, Artificial Sequence
  Synthetic Construct
caaatgcagccgtgtgaaaaca

SEQ ID NO: 35610 - DNA, 25 bp, Artificial Sequence
  Synthetic Construct
gacattggtggtaaatttgcagtga

SEQ ID NO: 35611 - DNA, 22 bp, Artificial Sequence
  Synthetic Construct
gggaaagcctcatgggatggaa

SEQ ID NO: 35612 - DNA, 19 bp, Artificial Sequence
  Synthetic Construct
cccgcatgcctgtgtctca

SEQ ID NO: 35613 - DNA, 22 bp, Artificial Sequence
  Synthetic Construct
gagttgtgcttccacagtccaa

SEQ ID NO: 35614 - DNA, 22 bp, Artificial Sequence
  Synthetic Construct
ggaaaacagcagcgaagaggaa

SEQ ID NO: 35615 - DNA, 22 bp, Artificial Sequence
  Synthetic Construct
ctgagagctgtcttgggctcta

SEQ ID NO: 35616 - DNA, 25 bp, Artificial Sequence
  Synthetic Construct
ggggctaaatgtgttgctcttcagt

SEQ ID NO: 35617 - DNA, 21 bp, Artificial Sequence
  Synthetic Construct
aaaccaggctccccagcttca

SEQ ID NO: 35618 - DNA, 20 bp, Artificial Sequence
  Synthetic Construct
agcaacgggagaggatgagt

SEQ ID NO: 35619 - DNA, 24 bp, Artificial Sequence
  Synthetic Construct
cgttctcctccctcaaagcaacat

SEQ ID NO: 35620 - DNA, 23 bp, Artificial Sequence
  Synthetic Construct
gtggtttgaaagagctggacttc

SEQ ID NO: 35621 - DNA, 21 bp, Artificial Sequence
  Synthetic Construct
aaggcacagctcgctgagttc

SEQ ID NO: 35622 - DNA, 21 bp, Artificial Sequence
  Synthetic Construct
ccctggggtgcatgagtccaa

SEQ ID NO: 35623 - DNA, 20 bp, Artificial Sequence
  Synthetic Construct
ccctgcgagagggctagaaa

SEQ ID NO: 35624 - DNA, 24 bp, Artificial Sequence
  Synthetic Construct
ggtagccatccaggtagacccaaa

SEQ ID NO: 35625 - DNA, 22 bp, Artificial Sequence
  Synthetic Construct
aaggggtctcggtttcctcgta

SEQ ID NO: 35626 - DNA, 20 bp, Artificial Sequence
  Synthetic Construct
tttgcagccttcaccaggaa

SEQ ID NO: 35627 - DNA, 25 bp, Artificial Sequence
  Synthetic Construct
caggcagaacttttcaggtcagaga

SEQ ID NO: 35628 - DNA, 20 bp, Artificial Sequence
  Synthetic Construct
cccaggcaatgacactggaa

SEQ ID NO: 35629 - DNA, 25 bp, Artificial Sequence
  Synthetic Construct
gtggaattacacacagctcctccat

SEQ ID NO: 35630 - DNA, 25 bp, Artificial Sequence
  Synthetic Construct
ggggcacagttaatgaatggtgaga

SEQ ID NO: 35631 - DNA, 22 bp, Artificial Sequence
  Synthetic Construct
acctgcagggacctgttagcat

SEQ ID NO: 35632 - DNA, 22 bp, Artificial Sequence
  Synthetic Construct
gagacagagaagggtggcatct

SEQ ID NO: 35633 - DNA, 20 bp, Artificial Sequence
  Synthetic Construct
ggcggtagcaatctctgctt

SEQ ID NO: 35634 - DNA, 24 bp, Artificial Sequence
  Synthetic Construct
cccattgacatcatccgagagctt

SEQ ID NO: 35635 - DNA, 25 bp, Artificial Sequence
  Synthetic Construct
cacagaattgtgccagtgtttctct

SEQ ID NO: 35636 - DNA, 29 bp, Artificial Sequence
  Synthetic Construct
ctaatattctccgtgtctctagtctcttc

SEQ ID NO: 35637 - DNA, 25 bp, Artificial Sequence
  Synthetic Construct
cttccaaacgctataggaagagact

SEQ ID NO: 35638 - DNA, 24 bp, Artificial Sequence
  Synthetic Construct
tcagctatagacacaccagcttct

SEQ ID NO: 35639 - DNA, 27 bp, Artificial Sequence
  Synthetic Construct
cctcctgactctatcgtctctggattg

SEQ ID NO: 35640 - DNA, 21 bp, Artificial Sequence
  Synthetic Construct
cctgctgctcttggtgacagt

SEQ ID NO: 35641 - DNA, 21 bp, Artificial Sequence
  Synthetic Construct
aggggaacttcaggggtggtt

SEQ ID NO: 35642 - DNA, 20 bp, Artificial Sequence
  Synthetic Construct
agcagcacagacgggagtca

SEQ ID NO: 35643 - DNA, 22 bp, Artificial Sequence
  Synthetic Construct
tccccgctctgttcttcctttg

SEQ ID NO: 35644 - DNA, 20 bp, Artificial Sequence
  Synthetic Construct
tccatccacggctcagcttt

SEQ ID NO: 35645 - DNA, 23 bp, Artificial Sequence
  Synthetic Construct
caggtgggacaagccatttgaga

SEQ ID NO: 35646 - DNA, 19 bp, Artificial Sequence
  Synthetic Construct
ggtgctggggcagactctt

SEQ ID NO: 35647 - DNA, 19 bp, Artificial Sequence
  Synthetic Construct
tgtttccccacccgcattg

SEQ ID NO: 35648 - DNA, 24 bp, Artificial Sequence
  Synthetic Construct
cggttggtatttcggacatgcaat

SEQ ID NO: 35649 - DNA, 30 bp, Artificial Sequence
  Synthetic Construct
gacatattaaccttatagcccaccaacctt

SEQ ID NO: 35650 - DNA, 22 bp, Artificial Sequence
  Synthetic Construct
ccttctcaactggagcctgaac

SEQ ID NO: 35651 - DNA, 23 bp, Artificial Sequence
  Synthetic Construct
tctgagccttgctctcatctaca

SEQ ID NO: 35652 - DNA, 23 bp, Artificial Sequence
  Synthetic Construct
gttctggtaggtgggagttctct

SEQ ID NO: 35653 - DNA, 26 bp, Artificial Sequence
  Synthetic Construct
cagactaaatgatgtgactggtgttc

SEQ ID NO: 35654 - DNA, 26 bp, Artificial Sequence
  Synthetic Construct
ccaggcctatcctttatctccgatca

SEQ ID NO: 35655 - DNA, 22 bp, Artificial Sequence
  Synthetic Construct
cctcttgcattgctgtttgtca

SEQ ID NO: 35656 - DNA, 22 bp, Artificial Sequence
  Synthetic Construct
ccgctcccactgctcctatttt

SEQ ID NO: 35657 - DNA, 25 bp, Artificial Sequence
  Synthetic Construct
ggtgaacatgagatgggctcctaac

SEQ ID NO: 35658 - DNA, 21 bp, Artificial Sequence
  Synthetic Construct
ttagccttgaccggggtctga

SEQ ID NO: 35659 - DNA, 24 bp, Artificial Sequence
  Synthetic Construct
atcaggcagattcaactcctttca

SEQ ID NO: 35660 - DNA, 19 bp, Artificial Sequence
  Synthetic Construct
ttcccctggctgcagaact

SEQ ID NO: 35661 - DNA, 23 bp, Artificial Sequence
  Synthetic Construct
agggctgtttgggagtaatttca

SEQ ID NO: 35662 - DNA, 22 bp, Artificial Sequence
  Synthetic Construct
cagtgattggctacctccacaa

SEQ ID NO: 35663 - DNA, 22 bp, Artificial Sequence
  Synthetic Construct
caccttgccctccagttcatag

SEQ ID NO: 35664 - DNA, 24 bp, Artificial Sequence
  Synthetic Construct
tctctatttggcgagaggtaggaa

SEQ ID NO: 35665 - DNA, 23 bp, Artificial Sequence
  Synthetic Construct
ggagccacattaagtcccctact

SEQ ID NO: 35666 - DNA, 22 bp, Artificial Sequence
  Synthetic Construct
gccaccatgccatgcaactcta

SEQ ID NO: 35667 - DNA, 20 bp, Artificial Sequence
  Synthetic Construct
agccgcatcgccatgtatga

SEQ ID NO: 35668 - DNA, 24 bp, Artificial Sequence
  Synthetic Construct
caggaccgtatacgaaaacacaca

SEQ ID NO: 35669 - DNA, 21 bp, Artificial Sequence
  Synthetic Construct
ctgtcattgctgggtgcagaa

SEQ ID NO: 35670 - DNA, 24 bp, Artificial Sequence
  Synthetic Construct
gtgatggtgggtgttagcatcttc

SEQ ID NO: 35671 - DNA, 23 bp, Artificial Sequence
  Synthetic Construct
cgtgctggaacctgaattgaaac

SEQ ID NO: 35672 - DNA, 22 bp, Artificial Sequence
  Synthetic Construct
gcacagacagaggggagtttca

SEQ ID NO: 35673 - DNA, 22 bp, Artificial Sequence
  Synthetic Construct
cccggagagaagacaagggttt

SEQ ID NO: 35674 - DNA, 20 bp, Artificial Sequence
  Synthetic Construct
cctcgctaaggacccagcat

SEQ ID NO: 35675 - DNA, 22 bp, Artificial Sequence
  Synthetic Construct
aaggctggagcttctccctaga

SEQ ID NO: 35676 - DNA, 24 bp, Artificial Sequence
  Synthetic Construct
acaaagaaatagcagtggctgaca

SEQ ID NO: 35677 - DNA, 24 bp, Artificial Sequence
  Synthetic Construct
gaaaaaccctgcttgctatgaact

SEQ ID NO: 35678 - DNA, 28 bp, Artificial Sequence
  Synthetic Construct
gctggggaaatgaacttgaaaggattag

SEQ ID NO: 35679 - DNA, 20 bp, Artificial Sequence
  Synthetic Construct
gccaccaagccagagctcaa

SEQ ID NO: 35680 - DNA, 19 bp, Artificial Sequence
  Synthetic Construct
gcccacctacccggataca

SEQ ID NO: 35681 - DNA, 19 bp, Artificial Sequence
  Synthetic Construct
acactgcctggggctacaa

SEQ ID NO: 35682 - DNA, 22 bp, Artificial Sequence
  Synthetic Construct
cagtaggcaagggatggagtgt

SEQ ID NO: 35683 - DNA, 22 bp, Artificial Sequence
  Synthetic Construct
ggctggatgaccatggactact

SEQ ID NO: 35684 - DNA, 21 bp, Artificial Sequence
  Synthetic Construct
caagggactggatgctgttca

SEQ ID NO: 35685 - DNA, 23 bp, Artificial Sequence
  Synthetic Construct
ggaaggccatggtcaaggagatg

SEQ ID NO: 35686 - DNA, 21 bp, Artificial Sequence
  Synthetic Construct
aggacaatggcccctctcagt

SEQ ID NO: 35687 - DNA, 25 bp, Artificial Sequence
  Synthetic Construct
acctaaccaccacattgtgagaaag

SEQ ID NO: 35688 - DNA, 20 bp, Artificial Sequence
  Synthetic Construct
aaggctgggtgcaggactga

SEQ ID NO: 35689 - DNA, 24 bp, Artificial Sequence
  Synthetic Construct
gtgtagtcaagcttgccaccagat

SEQ ID NO: 35690 - DNA, 23 bp, Artificial Sequence
  Synthetic Construct
gacagaatcctcgccgttctcaa

SEQ ID NO: 35691 - DNA, 22 bp, Artificial Sequence
  Synthetic Construct
gtgggaaaccctcaagccaaag

SEQ ID NO: 35692 - DNA, 21 bp, Artificial Sequence
  Synthetic Construct
ctggttctgtctgtgcagcta

SEQ ID NO: 35693 - DNA, 24 bp, Artificial Sequence
  Synthetic Construct
ggaagcatatagggctggggaaag

SEQ ID NO: 35694 - DNA, 20 bp, Artificial Sequence
  Synthetic Construct
ggccacagctcctgtcttca

SEQ ID NO: 35695 - DNA, 22 bp, Artificial Sequence
  Synthetic Construct
tggtggatttggaagggtttga

SEQ ID NO: 35696 - DNA, 20 bp, Artificial Sequence
  Synthetic Construct
acccgtgactctgctgaact

SEQ ID NO: 35697 - DNA, 24 bp, Artificial Sequence
  Synthetic Construct
ctttcctgggaatgtaggaacaca

SEQ ID NO: 35698 - DNA, 30 bp, Artificial Sequence
  Synthetic Construct
ccatctatttatgtcgaaaggcactgtact

SEQ ID NO: 35699 - DNA, 24 bp, Artificial Sequence
  Synthetic Construct
gccatggatactagcgcaggacaa

SEQ ID NO: 35700 - DNA, 21 bp, Artificial Sequence
  Synthetic Construct
atgcgctgcaccccagtgatt

SEQ ID NO: 35701 - DNA, 24 bp, Artificial Sequence
  Synthetic Construct
ggaatccaacaggaccacaccaat

SEQ ID NO: 35702 - DNA, 24 bp, Artificial Sequence
  Synthetic Construct
ggagctgcaaggagaaggagaaca

SEQ ID NO: 35703 - DNA, 24 bp, Artificial Sequence
  Synthetic Construct
gcacttactgaaaggggagcttct

SEQ ID NO: 35704 - DNA, 22 bp, Artificial Sequence
  Synthetic Construct
gctccaccttcattccccacat

SEQ ID NO: 35705 - DNA, 22 bp, Artificial Sequence
  Synthetic Construct
cgcatctttcccagagcaccta

SEQ ID NO: 35706 - DNA, 23 bp, Artificial Sequence
  Synthetic Construct
ggaagattgcccagaacaggaaa

SEQ ID NO: 35707 - DNA, 20 bp, Artificial Sequence
  Synthetic Construct
aggttcccgaggggcctgaa

SEQ ID NO: 35708 - DNA, 22 bp, Artificial Sequence
  Synthetic Construct
cctcactttctctgccaaggtt

SEQ ID NO: 35709 - DNA, 25 bp, Artificial Sequence
  Synthetic Construct
ctgcagcttcgttttgtaagcagta

SEQ ID NO: 35710 - DNA, 22 bp, Artificial Sequence
  Synthetic Construct
caggcaacacaagtcccagaag

SEQ ID NO: 35711 - DNA, 25 bp, Artificial Sequence
  Synthetic Construct
tggagatgacacagacataaacaca

SEQ ID NO: 35712 - DNA, 20 bp, Artificial Sequence
  Synthetic Construct
ttcccacccggcacatggtt

SEQ ID NO: 35713 - DNA, 19 bp, Artificial Sequence
  Synthetic Construct
tgggtcctgagggtgacaa

SEQ ID NO: 35714 - DNA, 23 bp, Artificial Sequence
  Synthetic Construct
ggagggaaaagggattggactgt

SEQ ID NO: 35715 - DNA, 21 bp, Artificial Sequence
  Synthetic Construct
gcttctctcccatggccagtt

SEQ ID NO: 35716 - DNA, 23 bp, Artificial Sequence
  Synthetic Construct
ggaaaatggagccgatggagatg

SEQ ID NO: 35717 - DNA, 24 bp, Artificial Sequence
  Synthetic Construct
ggaacctcccagaacctcctagtt

SEQ ID NO: 35718 - DNA, 22 bp, Artificial Sequence
  Synthetic Construct
ctgacagaaattggccccaaac

SEQ ID NO: 35719 - DNA, 25 bp, Artificial Sequence
  Synthetic Construct
gcatctttccccaaactcctacctt

SEQ ID NO: 35720 - DNA, 19 bp, Artificial Sequence
  Synthetic Construct
tggcacggtcctccaagaa

SEQ ID NO: 35721 - DNA, 24 bp, Artificial Sequence
  Synthetic Construct
gtgacctgctgtccttccagaaaa

SEQ ID NO: 35722 - DNA, 21 bp, Artificial Sequence
  Synthetic Construct
tgctccagagccagacccaaa

SEQ ID NO: 35723 - DNA, 22 bp, Artificial Sequence
  Synthetic Construct
cccagctaaagcatggcagaca

SEQ ID NO: 35724 - DNA, 22 bp, Artificial Sequence
  Synthetic Construct
gcaggctgacgtatgtgtctga

SEQ ID NO: 35725 - DNA, 21 bp, Artificial Sequence
  Synthetic Construct
gggtttcatgccactgaggtt

SEQ ID NO: 35726 - DNA, 21 bp, Artificial Sequence
  Synthetic Construct
cgctgcttctccacaccaagt

SEQ ID NO: 35727 - DNA, 24 bp, Artificial Sequence
  Synthetic Construct
cctctctgaggtcttgggaagcaa

SEQ ID NO: 35728 - DNA, 23 bp, Artificial Sequence
  Synthetic Construct
ggcggattggattagctgcttgt

SEQ ID NO: 35729 - DNA, 24 bp, Artificial Sequence
  Synthetic Construct
cagagcatcaaatgctacccttgt

SEQ ID NO: 35730 - DNA, 20 bp, Artificial Sequence
  Synthetic Construct
aaaaggcacagccagtccaa

SEQ ID NO: 35731 - DNA, 23 bp, Artificial Sequence
  Synthetic Construct
tcagtacttactccctgccagtt

SEQ ID NO: 35732 - DNA, 26 bp, Artificial Sequence
  Synthetic Construct
caccattgctcctattccatctaaac

SEQ ID NO: 35733 - DNA, 25 bp, Artificial Sequence
  Synthetic Construct
ggtctcagtaagaatgccctgcttt

SEQ ID NO: 35734 - DNA, 24 bp, Artificial Sequence
  Synthetic Construct
cctgcctggtgttcagtgtcatag

SEQ ID NO: 35735 - DNA, 25 bp, Artificial Sequence
  Synthetic Construct
gcaaacatacagtggctctttcagt

SEQ ID NO: 35736 - DNA, 24 bp, Artificial Sequence
  Synthetic Construct
cctgcagaattcaaaggctcaact

SEQ ID NO: 35737 - DNA, 26 bp, Artificial Sequence
  Synthetic Construct
caccagggaaatcagagacaatgatg

SEQ ID NO: 35738 - DNA, 20 bp, Artificial Sequence
  Synthetic Construct
ccccttgggcattggctgat

SEQ ID NO: 35739 - DNA, 24 bp, Artificial Sequence
  Synthetic Construct
ccctgctgaaaccaggtgtgagtt

SEQ ID NO: 35740 - DNA, 20 bp, Artificial Sequence
  Synthetic Construct
tctgctacatggggcctttg

SEQ ID NO: 35741 - DNA, 25 bp, Artificial Sequence
  Synthetic Construct
ggtggaaggaatccatgagttgagt

SEQ ID NO: 35742 - DNA, 21 bp, Artificial Sequence
  Synthetic Construct
gctcccagttggatgctggta

SEQ ID NO: 35743 - DNA, 24 bp, Artificial Sequence
  Synthetic Construct
gggctatagtcattgggtggatga

SEQ ID NO: 35744 - DNA, 21 bp, Artificial Sequence
  Synthetic Construct
catcaacacagccctggcatt

SEQ ID NO: 35745 - DNA, 19 bp, Artificial Sequence
  Synthetic Construct
atggccaccagtgggaaga

SEQ ID NO: 35746 - DNA, 20 bp, Artificial Sequence
  Synthetic Construct
tgagtgaggggtgtcgagat

SEQ ID NO: 35747 - DNA, 23 bp, Artificial Sequence
  Synthetic Construct
taatgggaggctggaggcaggtt

SEQ ID NO: 35748 - DNA, 24 bp, Artificial Sequence
  Synthetic Construct
gtctaaaatgaaccctgcccaact

SEQ ID NO: 35749 - DNA, 23 bp, Artificial Sequence
  Synthetic Construct
ggctaacagtgccatttgtgaaa

SEQ ID NO: 35750 - DNA, 22 bp, Artificial Sequence
  Synthetic Construct
aggaatgggacagaccctaagt

SEQ ID NO: 35751 - DNA, 20 bp, Artificial Sequence
  Synthetic Construct
agcccctcaacaggttccat

SEQ ID NO: 35752 - DNA, 26 bp, Artificial Sequence
  Synthetic Construct
gcaattgtcttagtgtcatccagcta

SEQ ID NO: 35753 - DNA, 21 bp, Artificial Sequence
  Synthetic Construct
ccttcagccctcagcttccat

SEQ ID NO: 35754 - DNA, 24 bp, Artificial Sequence
  Synthetic Construct
gtctgcaagaaactggcttaacaa

SEQ ID NO: 35755 - DNA, 26 bp, Artificial Sequence
  Synthetic Construct
cagttgtagctgaaatcagaggttga

SEQ ID NO: 35756 - DNA, 25 bp, Artificial Sequence
  Synthetic Construct
tgtgacagaagtttgtgagccatta

SEQ ID NO: 35757 - DNA, 23 bp, Artificial Sequence
  Synthetic Construct
ctcctgcctgggacaatgtaatg

SEQ ID NO: 35758 - DNA, 22 bp, Artificial Sequence
  Synthetic Construct
catcacagcacatgacccaaag

SEQ ID NO: 35759 - DNA, 25 bp, Artificial Sequence
  Synthetic Construct
ggtcaggacgtacgcatttggatta

SEQ ID NO: 35760 - DNA, 20 bp, Artificial Sequence
  Synthetic Construct
tggtcagcccagggtgattt

SEQ ID NO: 35761 - DNA, 23 bp, Artificial Sequence
  Synthetic Construct
tcaggtaactctggtgacaggaa

SEQ ID NO: 35762 - DNA, 25 bp, Artificial Sequence
  Synthetic Construct
ggctttcctctctccaggtttcctt

SEQ ID NO: 35763 - DNA, 21 bp, Artificial Sequence
  Synthetic Construct
gcgctgcgtggaactaaaaag

SEQ ID NO: 35764 - DNA, 20 bp, Artificial Sequence
  Synthetic Construct
gctggcctggcagtgaaact

SEQ ID NO: 35765 - DNA, 22 bp, Artificial Sequence
  Synthetic Construct
tccatggccccgactaagtgta

SEQ ID NO: 35766 - DNA, 23 bp, Artificial Sequence
  Synthetic Construct
cctgcatcggaattcccctgatt

SEQ ID NO: 35767 - DNA, 26 bp, Artificial Sequence
  Synthetic Construct
ggtctgtgttttcagtggaagaaact

SEQ ID NO: 35768 - DNA, 25 bp, Artificial Sequence
  Synthetic Construct
gtccctgaaactacagtttggatgt

SEQ ID NO: 35769 - DNA, 20 bp, Artificial Sequence
  Synthetic Construct
gcctggctgtttggaaggaa

SEQ ID NO: 35770 - DNA, 20 bp, Artificial Sequence
  Synthetic Construct
gcacctccacagagtgcttt

SEQ ID NO: 35771 - DNA, 22 bp, Artificial Sequence
  Synthetic Construct
gagcaccaggaaacagcttgta

SEQ ID NO: 35772 - DNA, 22 bp, Artificial Sequence
  Synthetic Construct
ggctctggctctgtcttcattg

SEQ ID NO: 35773 - DNA, 21 bp, Artificial Sequence
  Synthetic Construct
ggcattctagggctgcaggaa

SEQ ID NO: 35774 - DNA, 20 bp, Artificial Sequence
  Synthetic Construct
atggcccagggctttacaac

SEQ ID NO: 35775 - DNA, 20 bp, Artificial Sequence
  Synthetic Construct
ttcactgccctgcagcaaga

SEQ ID NO: 35776 - DNA, 23 bp, Artificial Sequence
  Synthetic Construct
cagctctcaaaccctcaccattg

SEQ ID NO: 35777 - DNA, 23 bp, Artificial Sequence
  Synthetic Construct
gcttctcattcctgcctccaagt

SEQ ID NO: 35778 - DNA, 20 bp, Artificial Sequence
  Synthetic Construct
cacaattgcccgccatggaa

SEQ ID NO: 35779 - DNA, 20 bp, Artificial Sequence
  Synthetic Construct
acccaggctggcgactctaa

SEQ ID NO: 35780 - DNA, 21 bp, Artificial Sequence
  Synthetic Construct
atggccacacacccctgacat

SEQ ID NO: 35781 - DNA, 20 bp, Artificial Sequence
  Synthetic Construct
gaagggtggccattgtctga

SEQ ID NO: 35782 - DNA, 23 bp, Artificial Sequence
  Synthetic Construct
ccaggagagggagccattgaatc

SEQ ID NO: 35783 - DNA, 21 bp, Artificial Sequence
  Synthetic Construct
gagctgggagagagacaggaa

SEQ ID NO: 35784 - DNA, 29 bp, Artificial Sequence
  Synthetic Construct
gagaaactgagttatagagccatcgagta

SEQ ID NO: 35785 - DNA, 24 bp, Artificial Sequence
  Synthetic Construct
cgagactcaaacggagaggcaaac

SEQ ID NO: 35786 - DNA, 22 bp, Artificial Sequence
  Synthetic Construct
aaccagtgaatgccatgagtgt

SEQ ID NO: 35787 - DNA, 21 bp, Artificial Sequence
  Synthetic Construct
gtctgcaacaagcaccagcat

SEQ ID NO: 35788 - DNA, 22 bp, Artificial Sequence
  Synthetic Construct
ggcgacatggtctgaggatgaa

SEQ ID NO: 35789 - DNA, 21 bp, Artificial Sequence
  Synthetic Construct
tagaggcgtccctgggtgaga

SEQ ID NO: 35790 - DNA, 19 bp, Artificial Sequence
  Synthetic Construct
agagcaccccagcatggtt

SEQ ID NO: 35791 - DNA, 22 bp, Artificial Sequence
  Synthetic Construct
acctccaaaaccggaaaaggaa

SEQ ID NO: 35792 - DNA, 20 bp, Artificial Sequence
  Synthetic Construct
tttggcaagcccaccagtga

SEQ ID NO: 35793 - DNA, 26 bp, Artificial Sequence
  Synthetic Construct
cgggacagaaaattccgtaagaaaga

SEQ ID NO: 35794 - DNA, 22 bp, Artificial Sequence
  Synthetic Construct
aggatcaggagggccaggtaga

SEQ ID NO: 35795 - DNA, 20 bp, Artificial Sequence
  Synthetic Construct
taccacaacgtgcccagact

SEQ ID NO: 35796 - DNA, 27 bp, Artificial Sequence
  Synthetic Construct
cagctctgaatgtattccagctctttc

SEQ ID NO: 35797 - DNA, 21 bp, Artificial Sequence
  Synthetic Construct
ggtagcctgggaagctgctat

SEQ ID NO: 35798 - DNA, 21 bp, Artificial Sequence
  Synthetic Construct
agagtggtcagggccttacat

SEQ ID NO: 35799 - DNA, 20 bp, Artificial Sequence
  Synthetic Construct
tgactccccaggcacctcta

SEQ ID NO: 35800 - DNA, 24 bp, Artificial Sequence
  Synthetic Construct
cctcagtgagagccacaagcgata

SEQ ID NO: 35801 - DNA, 21 bp, Artificial Sequence
  Synthetic Construct
ctgctttccaacagccacact

SEQ ID NO: 35802 - DNA, 22 bp, Artificial Sequence
  Synthetic Construct
cccacgtgtccaggcttgattt

SEQ ID NO: 35803 - DNA, 20 bp, Artificial Sequence
  Synthetic Construct
tgctcagggtctccctgttt

SEQ ID NO: 35804 - DNA, 22 bp, Artificial Sequence
  Synthetic Construct
gactgtgggagaagccaactca

SEQ ID NO: 35805 - DNA, 24 bp, Artificial Sequence
  Synthetic Construct
gcggaaggataaagggtcctgatg

SEQ ID NO: 35806 - DNA, 26 bp, Artificial Sequence
  Synthetic Construct
cggaaccagatagttttgtggctaag

SEQ ID NO: 35807 - DNA, 19 bp, Artificial Sequence
  Synthetic Construct
atcggcctccacccaccat

SEQ ID NO: 35808 - DNA, 22 bp, Artificial Sequence
  Synthetic Construct
ggaagtggtgctgtggcttcat

SEQ ID NO: 35809 - DNA, 23 bp, Artificial Sequence
  Synthetic Construct
ggattataactgcgtgccaccat

SEQ ID NO: 35810 - DNA, 22 bp, Artificial Sequence
  Synthetic Construct
gctttgctaaggccaggccaat

SEQ ID NO: 35811 - DNA, 27 bp, Artificial Sequence
  Synthetic Construct
gcacatctacaatatgtttggcaccat

SEQ ID NO: 35812 - DNA, 22 bp, Artificial Sequence
  Synthetic Construct
gcacgggcactgagaaaagtca

SEQ ID NO: 35813 - DNA, 21 bp, Artificial Sequence
  Synthetic Construct
tggcctttgccctcagctact

SEQ ID NO: 35814 - DNA, 20 bp, Artificial Sequence
  Synthetic Construct
tagaggcacccactcaccaa

SEQ ID NO: 35815 - DNA, 22 bp, Artificial Sequence
  Synthetic Construct
cgggcaattcccaaggcttagt

SEQ ID NO: 35816 - DNA, 19 bp, Artificial Sequence
  Synthetic Construct
tgaggcctgggtcctcagt

SEQ ID NO: 35817 - DNA, 22 bp, Artificial Sequence
  Synthetic Construct
cctgcttccctctgagctgttt

SEQ ID NO: 35818 - DNA, 22 bp, Artificial Sequence
  Synthetic Construct
ctcccagtgtttcaggggttag

SEQ ID NO: 35819 - DNA, 20 bp, Artificial Sequence
  Synthetic Construct
acctgtcccctgaacccaat

SEQ ID NO: 35820 - DNA, 25 bp, Artificial Sequence
  Synthetic Construct
ggtgaccctcattggagttgacctt

SEQ ID NO: 35821 - DNA, 22 bp, Artificial Sequence
  Synthetic Construct
ggctagaggaggtggacaggat

SEQ ID NO: 35822 - DNA, 21 bp, Artificial Sequence
  Synthetic Construct
aagtcccgcctggtgttcact

SEQ ID NO: 35823 - DNA, 22 bp, Artificial Sequence
  Synthetic Construct
ctgagctgtgtcttcccagatg

SEQ ID NO: 35824 - DNA, 22 bp, Artificial Sequence
  Synthetic Construct
gcagagcgttgcttaggccatt

SEQ ID NO: 35825 - DNA, 28 bp, Artificial Sequence
  Synthetic Construct
gcccttctggatgacaataaggtcttga

SEQ ID NO: 35826 - DNA, 20 bp, Artificial Sequence
  Synthetic Construct
tgactgtgtccctcgcacat

SEQ ID NO: 35827 - DNA, 24 bp, Artificial Sequence
  Synthetic Construct
tttttagtgccacaggttggattg

SEQ ID NO: 35828 - DNA, 21 bp, Artificial Sequence
  Synthetic Construct
gagtaaagcagggagcagcat

SEQ ID NO: 35829 - DNA, 22 bp, Artificial Sequence
  Synthetic Construct
cctgaaagcctcgggataccat

SEQ ID NO: 35830 - DNA, 22 bp, Artificial Sequence
  Synthetic Construct
gctcgcacattgctgtctgctt

SEQ ID NO: 35831 - DNA, 22 bp, Artificial Sequence
  Synthetic Construct
cggccaaccttagacacagcta

SEQ ID NO: 35832 - DNA, 20 bp, Artificial Sequence
  Synthetic Construct
gcaaagcgagagtcctgcta

SEQ ID NO: 35833 - DNA, 21 bp, Artificial Sequence
  Synthetic Construct
ctgggcatctttcctcacctt

SEQ ID NO: 35834 - DNA, 21 bp, Artificial Sequence
  Synthetic Construct
agcaagcatgggctccactac

SEQ ID NO: 35835 - DNA, 20 bp, Artificial Sequence
  Synthetic Construct
tgcatagggtcccggagtta

SEQ ID NO: 35836 - DNA, 21 bp, Artificial Sequence
  Synthetic Construct
tctggctttggacctcacctt

SEQ ID NO: 35837 - DNA, 23 bp, Artificial Sequence
  Synthetic Construct
cagttcagctccttcctctgcta

SEQ ID NO: 35838 - DNA, 22 bp, Artificial Sequence
  Synthetic Construct
ctgggaagtaagcaggctgaga

SEQ ID NO: 35839 - DNA, 20 bp, Artificial Sequence
  Synthetic Construct
tccaggctcacccacttcat

SEQ ID NO: 35840 - DNA, 21 bp, Artificial Sequence
  Synthetic Construct
cagattgccagggaagtgaca

SEQ ID NO: 35841 - DNA, 25 bp, Artificial Sequence
  Synthetic Construct
gaaccaaagcatcaagaaggaaact

SEQ ID NO: 35842 - DNA, 20 bp, Artificial Sequence
  Synthetic Construct
ggcctgttgggtgatagcaa

SEQ ID NO: 35843 - DNA, 23 bp, Artificial Sequence
  Synthetic Construct
ggagcaaagggaaccaaatgact

SEQ ID NO: 35844 - DNA, 20 bp, Artificial Sequence
  Synthetic Construct
acctggctccagccctgatt

SEQ ID NO: 35845 - DNA, 19 bp, Artificial Sequence
  Synthetic Construct
gcaggcactgggcctcaaa

SEQ ID NO: 35846 - DNA, 28 bp, Artificial Sequence
  Synthetic Construct
ccttacttctagttcctactcagcttct

SEQ ID NO: 35847 - DNA, 20 bp, Artificial Sequence
  Synthetic Construct
agctgaggtctggtgcagta

SEQ ID NO: 35848 - DNA, 22 bp, Artificial Sequence
  Synthetic Construct
gtgacaccagcagcttccaaac

SEQ ID NO: 35849 - DNA, 22 bp, Artificial Sequence
  Synthetic Construct
gggcagactatgctggtggatt

SEQ ID NO: 35850 - DNA, 22 bp, Artificial Sequence
  Synthetic Construct
cagctgggcatctaggaagcat

SEQ ID NO: 35851 - DNA, 22 bp, Artificial Sequence
  Synthetic Construct
cacacagtcctccctggaatct

SEQ ID NO: 35852 - DNA, 20 bp, Artificial Sequence
  Synthetic Construct
tgggccccaagttcacaagt

SEQ ID NO: 35853 - DNA, 23 bp, Artificial Sequence
  Synthetic Construct
gcagaaatgcttccaccaacttc

SEQ ID NO: 35854 - DNA, 22 bp, Artificial Sequence
  Synthetic Construct
gggcatgaaggcttggtcaact

SEQ ID NO: 35855 - DNA, 25 bp, Artificial Sequence
  Synthetic Construct
tttatcggaaaggggagcaaatact

SEQ ID NO: 35856 - DNA, 24 bp, Artificial Sequence
  Synthetic Construct
cagctcctctttccactctgaatc

SEQ ID NO: 35857 - DNA, 24 bp, Artificial Sequence
  Synthetic Construct
ctggaaggtaatgggaaactgcaa

SEQ ID NO: 35858 - DNA, 22 bp, Artificial Sequence
  Synthetic Construct
ggtgaacgacggggatgtttac

SEQ ID NO: 35859 - DNA, 23 bp, Artificial Sequence
  Synthetic Construct
gcctctatgctcttgcctactac

SEQ ID NO: 35860 - DNA, 19 bp, Artificial Sequence
  Synthetic Construct
tcagtggcacgcagcagta

SEQ ID NO: 35861 - DNA, 22 bp, Artificial Sequence
  Synthetic Construct
ctcaccctccctacaccaaaac

SEQ ID NO: 35862 - DNA, 25 bp, Artificial Sequence
  Synthetic Construct
tcccaaaatgatgatgagaggtgtt

SEQ ID NO: 35863 - DNA, 25 bp, Artificial Sequence
  Synthetic Construct
aggaaggagaaaattatgggtgcaa

SEQ ID NO: 35864 - DNA, 22 bp, Artificial Sequence
  Synthetic Construct
aatcaggaccggagccccagat

SEQ ID NO: 35865 - DNA, 23 bp, Artificial Sequence
  Synthetic Construct
aagccagaatgtctgacctgaaa

SEQ ID NO: 35866 - DNA, 27 bp, Artificial Sequence
  Synthetic Construct
cctcctaggaatgtctgccatggattt

SEQ ID NO: 35867 - DNA, 24 bp, Artificial Sequence
  Synthetic Construct
gtctctgtgactcgcacatagttg

SEQ ID NO: 35868 - DNA, 18 bp, Artificial Sequence
  Synthetic Construct
agtgggctcctgggttga

SEQ ID NO: 35869 - DNA, 21 bp, Artificial Sequence
  Synthetic Construct
caaccttgcaccccagaaaca

SEQ ID NO: 35870 - DNA, 22 bp, Artificial Sequence
  Synthetic Construct
ggtcttctggctttacgtgttg

SEQ ID NO: 35871 - DNA, 22 bp, Artificial Sequence
  Synthetic Construct
tggttcaggaatgagccactct

SEQ ID NO: 35872 - DNA, 21 bp, Artificial Sequence
  Synthetic Construct
gcttactagtgccgggtgctt

SEQ ID NO: 35873 - DNA, 20 bp, Artificial Sequence
  Synthetic Construct
ggggccaagagctactgtgt

SEQ ID NO: 35874 - DNA, 23 bp, Artificial Sequence
  Synthetic Construct
ggtggaggtagcaaagcctcaaa

SEQ ID NO: 35875 - DNA, 25 bp, Artificial Sequence
  Synthetic Construct
gctggctaagcttttgtggacagat

SEQ ID NO: 35876 - DNA, 19 bp, Artificial Sequence
  Synthetic Construct
ttccccgtgggctggatca

SEQ ID NO: 35877 - DNA, 30 bp, Artificial Sequence
  Synthetic Construct
gcatctaaatcttcctagcgattggagaag

SEQ ID NO: 35878 - DNA, 21 bp, Artificial Sequence
  Synthetic Construct
ccaagacaaggtgctgctgat

SEQ ID NO: 35879 - DNA, 27 bp, Artificial Sequence
  Synthetic Construct
gacctgagaaaagagtgttatccaaga

SEQ ID NO: 35880 - DNA, 23 bp, Artificial Sequence
  Synthetic Construct
ctgcatccaaacagccctaaatg

SEQ ID NO: 35881 - DNA, 23 bp, Artificial Sequence
  Synthetic Construct
cccagcacaatagggaacttctt

SEQ ID NO: 35882 - DNA, 20 bp, Artificial Sequence
  Synthetic Construct
gcaccttgcaaccctctctt

SEQ ID NO: 35883 - DNA, 22 bp, Artificial Sequence
  Synthetic Construct
ggcaatcggtggtgcattcctt

SEQ ID NO: 35884 - DNA, 27 bp, Artificial Sequence
  Synthetic Construct
gcaggcccagaacttatagatgtcaac

SEQ ID NO: 35885 - DNA, 18 bp, Artificial Sequence
  Synthetic Construct
acaccacgcgctgacaga

SEQ ID NO: 35886 - DNA, 19 bp, Artificial Sequence
  Synthetic Construct
gctggccagggctttcagt

SEQ ID NO: 35887 - DNA, 20 bp, Artificial Sequence
  Synthetic Construct
ttcctcctggccctgccaaa

SEQ ID NO: 35888 - DNA, 23 bp, Artificial Sequence
  Synthetic Construct
ggcagaggctgctattataggtt

SEQ ID NO: 35889 - DNA, 20 bp, Artificial Sequence
  Synthetic Construct
ccgaggcatgtgctggatga

SEQ ID NO: 35890 - DNA, 26 bp, Artificial Sequence
  Synthetic Construct
ggctgtagattgcaaaagcaggacta

SEQ ID NO: 35891 - DNA, 20 bp, Artificial Sequence
  Synthetic Construct
aggggactgcagagaagtca

SEQ ID NO: 35892 - DNA, 20 bp, Artificial Sequence
  Synthetic Construct
actggcagcgctgtgtgatt

SEQ ID NO: 35893 - DNA, 21 bp, Artificial Sequence
  Synthetic Construct
tgtcctgccctgtggggattt

SEQ ID NO: 35894 - DNA, 25 bp, Artificial Sequence
  Synthetic Construct
ggagactcaaagggatcttgggtta

SEQ ID NO: 35895 - DNA, 26 bp, Artificial Sequence
  Synthetic Construct
gggaaattttagacctgcctccagaa

SEQ ID NO: 35896 - DNA, 23 bp, Artificial Sequence
  Synthetic Construct
gataaatcaggccacctgggaat

SEQ ID NO: 35897 - DNA, 22 bp, Artificial Sequence
  Synthetic Construct
cgtatgttgagggccagagagt

SEQ ID NO: 35898 - DNA, 23 bp, Artificial Sequence
  Synthetic Construct
gctgccttggttttccccagatt

SEQ ID NO: 35899 - DNA, 20 bp, Artificial Sequence
  Synthetic Construct
gttgaggcagatggcagtgt

SEQ ID NO: 35900 - DNA, 20 bp, Artificial Sequence
  Synthetic Construct
gggaagaaaacgggccaagt

SEQ ID NO: 35901 - DNA, 24 bp, Artificial Sequence
  Synthetic Construct
gggtttggagttagcttgactttg

SEQ ID NO: 35902 - DNA, 21 bp, Artificial Sequence
  Synthetic Construct
agcagtcaccctcggatccat

SEQ ID NO: 35903 - DNA, 22 bp, Artificial Sequence
  Synthetic Construct
cggcttttggccacctttgaga

SEQ ID NO: 35904 - DNA, 25 bp, Artificial Sequence
  Synthetic Construct
ctcagactcaaggggctctattaag

SEQ ID NO: 35905 - DNA, 26 bp, Artificial Sequence
  Synthetic Construct
gaagttctttagctgtaacccctctt

SEQ ID NO: 35906 - DNA, 24 bp, Artificial Sequence
  Synthetic Construct
ctgtgtccattccttctccaatga

SEQ ID NO: 35907 - DNA, 22 bp, Artificial Sequence
  Synthetic Construct
cagtgacctccactgcttgact

SEQ ID NO: 35908 - DNA, 21 bp, Artificial Sequence
  Synthetic Construct
tctcaacaggcacgtgagatg

SEQ ID NO: 35909 - DNA, 24 bp, Artificial Sequence
  Synthetic Construct
gagtcacagctaaccacaaacaca

SEQ ID NO: 35910 - DNA, 20 bp, Artificial Sequence
  Synthetic Construct
ccttcgcgttgcttcctttc

SEQ ID NO: 35911 - DNA, 20 bp, Artificial Sequence
  Synthetic Construct
atgaaccctgcctgcacaga

SEQ ID NO: 35912 - DNA, 25 bp, Artificial Sequence
  Synthetic Construct
tgtgatcagatccacgtttgtgtag

SEQ ID NO: 35913 - DNA, 20 bp, Artificial Sequence
  Synthetic Construct
agaatggcctgcaccacatc

SEQ ID NO: 35914 - DNA, 21 bp, Artificial Sequence
  Synthetic Construct
tgtgccatgactctcccttca

SEQ ID NO: 35915 - DNA, 22 bp, Artificial Sequence
  Synthetic Construct
gcctggatgaacctagccaaga

SEQ ID NO: 35916 - DNA, 19 bp, Artificial Sequence
  Synthetic Construct
tgccttcgtgcaggtgaca

SEQ ID NO: 35917 - DNA, 21 bp, Artificial Sequence
  Synthetic Construct
cctggtgctacccaacaccta

SEQ ID NO: 35918 - DNA, 24 bp, Artificial Sequence
  Synthetic Construct
aggaaagaaattgcagaccacaag

SEQ ID NO: 35919 - DNA, 21 bp, Artificial Sequence
  Synthetic Construct
gcccttccttctgcctgcaat

SEQ ID NO: 35920 - DNA, 23 bp, Artificial Sequence
  Synthetic Construct
ggggtttttggagcacaaaatgt

SEQ ID NO: 35921 - DNA, 18 bp, Artificial Sequence
  Synthetic Construct
tggagggcagcgatggta

SEQ ID NO: 35922 - DNA, 21 bp, Artificial Sequence
  Synthetic Construct
gtccttcagggcaacgaaagt

SEQ ID NO: 35923 - DNA, 24 bp, Artificial Sequence
  Synthetic Construct
ggtcagggcttcaggtatccattc

SEQ ID NO: 35924 - DNA, 21 bp, Artificial Sequence
  Synthetic Construct
atccgtgacgccctctctgaa

SEQ ID NO: 35925 - DNA, 19 bp, Artificial Sequence
  Synthetic Construct
gcacagggctgcctcactt

SEQ ID NO: 35926 - DNA, 20 bp, Artificial Sequence
  Synthetic Construct
tggcctttgggagcaggttt

SEQ ID NO: 35927 - DNA, 19 bp, Artificial Sequence
  Synthetic Construct
tctggtgggctggcgtgaa

SEQ ID NO: 35928 - DNA, 24 bp, Artificial Sequence
  Synthetic Construct
gccctgagaactgtatacgacctt

SEQ ID NO: 35929 - DNA, 24 bp, Artificial Sequence
  Synthetic Construct
ggcagttgaagtcatgaaactgaa

SEQ ID NO: 35930 - DNA, 20 bp, Artificial Sequence
  Synthetic Construct
aggctctcccggctctctgt

SEQ ID NO: 35931 - DNA, 23 bp, Artificial Sequence
  Synthetic Construct
gcaggtcacaagtccaggaaact

SEQ ID NO: 35932 - DNA, 20 bp, Artificial Sequence
  Synthetic Construct
ggccgtgaaagctgatctgt

SEQ ID NO: 35933 - DNA, 25 bp, Artificial Sequence
  Synthetic Construct
gagcttgggaaactacaaggtatga

SEQ ID NO: 35934 - DNA, 24 bp, Artificial Sequence
  Synthetic Construct
ccctcccaaaagcagacagcagta

SEQ ID NO: 35935 - DNA, 22 bp, Artificial Sequence
  Synthetic Construct
ccgtaggaagaaccaggtgtga

SEQ ID NO: 35936 - DNA, 20 bp, Artificial Sequence
  Synthetic Construct
aaccctgacggcagttgcta

SEQ ID NO: 35937 - DNA, 20 bp, Artificial Sequence
  Synthetic Construct
cgtggagtggtggcttggaa

SEQ ID NO: 35938 - DNA, 26 bp, Artificial Sequence
  Synthetic Construct
gggaaaattccagactgagagagttg

SEQ ID NO: 35939 - DNA, 22 bp, Artificial Sequence
  Synthetic Construct
caaaggcaccctgagctcatta

SEQ ID NO: 35940 - DNA, 21 bp, Artificial Sequence
  Synthetic Construct
cggctattagaccccagcaaa

SEQ ID NO: 35941 - DNA, 22 bp, Artificial Sequence
  Synthetic Construct
ccagacgctctgaaggctacaa

SEQ ID NO: 35942 - DNA, 22 bp, Artificial Sequence
  Synthetic Construct
gacaccaagggtgaagggaaga

SEQ ID NO: 35943 - DNA, 27 bp, Artificial Sequence
  Synthetic Construct
ggtatatgctgagtagacaaggacact

SEQ ID NO: 35944 - DNA, 22 bp, Artificial Sequence
  Synthetic Construct
agtccatggaaggcggtgtaag

SEQ ID NO: 35945 - DNA, 25 bp, Artificial Sequence
  Synthetic Construct
ggagttatcagtgagggatgtgtct

SEQ ID NO: 35946 - DNA, 23 bp, Artificial Sequence
  Synthetic Construct
gatcctcactggtggtaggatgt

SEQ ID NO: 35947 - DNA, 20 bp, Artificial Sequence
  Synthetic Construct
gccttgctcctgccaaactt

SEQ ID NO: 35948 - DNA, 22 bp, Artificial Sequence
  Synthetic Construct
atctcctgtcccagcatctttg

SEQ ID NO: 35949 - DNA, 20 bp, Artificial Sequence
  Synthetic Construct
aatgtacggcttgccgtttg

SEQ ID NO: 35950 - DNA, 20 bp, Artificial Sequence
  Synthetic Construct
gggagcagttgggactcaga

SEQ ID NO: 35951 - DNA, 20 bp, Artificial Sequence
  Synthetic Construct
cacacctgctgtcgtctgaa

SEQ ID NO: 35952 - DNA, 20 bp, Artificial Sequence
  Synthetic Construct
gcatggctcccatggttaca

SEQ ID NO: 35953 - DNA, 22 bp, Artificial Sequence
  Synthetic Construct
gctcttggaaggctgtgttttc

SEQ ID NO: 35954 - DNA, 22 bp, Artificial Sequence
  Synthetic Construct
tggttactgggctcccttgagt

SEQ ID NO: 35955 - DNA, 19 bp, Artificial Sequence
  Synthetic Construct
actccgacgtggccagtat

SEQ ID NO: 35956 - DNA, 20 bp, Artificial Sequence
  Synthetic Construct
aacacaggaggggcaggata

SEQ ID NO: 35957 - DNA, 20 bp, Artificial Sequence
  Synthetic Construct
tgtaggccattggcgcgtta

SEQ ID NO: 35958 - DNA, 25 bp, Artificial Sequence
  Synthetic Construct
ggagaaggcttaagttccacagcaa

SEQ ID NO: 35959 - DNA, 27 bp, Artificial Sequence
  Synthetic Construct
caggtactttgtgtcagctacatctca

SEQ ID NO: 35960 - DNA, 22 bp, Artificial Sequence
  Synthetic Construct
caagaagaagcaacccgactga

SEQ ID NO: 35961 - DNA, 20 bp, Artificial Sequence
  Synthetic Construct
tgggcagtcccagggaaata

SEQ ID NO: 35962 - DNA, 23 bp, Artificial Sequence
  Synthetic Construct
cagcttcacaaagtggcgttgtt

SEQ ID NO: 35963 - DNA, 20 bp, Artificial Sequence
  Synthetic Construct
ccccgagggtccttcctgta

SEQ ID NO: 35964 - DNA, 20 bp, Artificial Sequence
  Synthetic Construct
gaagcaggcgcagttacaca

SEQ ID NO: 35965 - DNA, 24 bp, Artificial Sequence
  Synthetic Construct
ccctgttctccctgcattttgaca

SEQ ID NO: 35966 - DNA, 21 bp, Artificial Sequence
  Synthetic Construct
ccacccaggtctgggagtatg

SEQ ID NO: 35967 - DNA, 22 bp, Artificial Sequence
  Synthetic Construct
ggcaagggtaagagccagcaaa

SEQ ID NO: 35968 - DNA, 21 bp, Artificial Sequence
  Synthetic Construct
ggagcccctagtctggacttc

SEQ ID NO: 35969 - DNA, 20 bp, Artificial Sequence
  Synthetic Construct
tgagtgcagggctggaaact

SEQ ID NO: 35970 - DNA, 20 bp, Artificial Sequence
  Synthetic Construct
gcctctatgccaggccaagt

SEQ ID NO: 35971 - DNA, 20 bp, Artificial Sequence
  Synthetic Construct
aggacatggcctggaagttg

SEQ ID NO: 35972 - DNA, 21 bp, Artificial Sequence
  Synthetic Construct
ggcgggaatcagccttcatca

SEQ ID NO: 35973 - DNA, 22 bp, Artificial Sequence
  Synthetic Construct
ccaatgcttggagcagggaact

SEQ ID NO: 35974 - DNA, 24 bp, Artificial Sequence
  Synthetic Construct
cctccttctgaccaatggcaaaca

SEQ ID NO: 35975 - DNA, 19 bp, Artificial Sequence
  Synthetic Construct
tggaggatgcgtggagcaa

SEQ ID NO: 35976 - DNA, 27 bp, Artificial Sequence
  Synthetic Construct
gcatctctacacctaccttcagccttt

SEQ ID NO: 35977 - DNA, 25 bp, Artificial Sequence
  Synthetic Construct
cctgccacattgccttatcctctac

SEQ ID NO: 35978 - DNA, 21 bp, Artificial Sequence
  Synthetic Construct
gtctctcacggcatggattgt

SEQ ID NO: 35979 - DNA, 23 bp, Artificial Sequence
  Synthetic Construct
cctcaatgaatggtgccgtggat

SEQ ID NO: 35980 - DNA, 20 bp, Artificial Sequence
  Synthetic Construct
gctgcaaagacacgctcaga

SEQ ID NO: 35981 - DNA, 21 bp, Artificial Sequence
  Synthetic Construct
agacatggtccctgcctggtt

SEQ ID NO: 35982 - DNA, 23 bp, Artificial Sequence
  Synthetic Construct
gcaaatgtttcagggaggcaatc

SEQ ID NO: 35983 - DNA, 22 bp, Artificial Sequence
  Synthetic Construct
ttccaggtggcttagggacttc

SEQ ID NO: 35984 - DNA, 24 bp, Artificial Sequence
  Synthetic Construct
gcattgttttgcctgctaggaact

SEQ ID NO: 35985 - DNA, 25 bp, Artificial Sequence
  Synthetic Construct
gcttatctcaagaccagtgcttgtt

SEQ ID NO: 35986 - DNA, 24 bp, Artificial Sequence
  Synthetic Construct
ggggtcagcttgactcttgtggtt

SEQ ID NO: 35987 - DNA, 20 bp, Artificial Sequence
  Synthetic Construct
acacaggtggtggcctctga

SEQ ID NO: 35988 - DNA, 20 bp, Artificial Sequence
  Synthetic Construct
gggctgccctggatgtgtta

SEQ ID NO: 35989 - DNA, 22 bp, Artificial Sequence
  Synthetic Construct
tgcccagacagcttggatgaag

SEQ ID NO: 35990 - DNA, 20 bp, Artificial Sequence
  Synthetic Construct
cagacagcccttgtgtgcat

SEQ ID NO: 35991 - DNA, 19 bp, Artificial Sequence
  Synthetic Construct
tgagtgccgggctccagaa

SEQ ID NO: 35992 - DNA, 26 bp, Artificial Sequence
  Synthetic Construct
gggagcagttcattgaaagcccaact

SEQ ID NO: 35993 - DNA, 24 bp, Artificial Sequence
  Synthetic Construct
ccacactgtgtatgactcccctta

SEQ ID NO: 35994 - DNA, 20 bp, Artificial Sequence
  Synthetic Construct
cccaaggagaggctgtcagt

SEQ ID NO: 35995 - DNA, 23 bp, Artificial Sequence
  Synthetic Construct
gccataggctaacctcacagaca

SEQ ID NO: 35996 - DNA, 23 bp, Artificial Sequence
  Synthetic Construct
cgccatttgagtttggccctgta

SEQ ID NO: 35997 - DNA, 20 bp, Artificial Sequence
  Synthetic Construct
ggcctaagaactgccccaat

SEQ ID NO: 35998 - DNA, 19 bp, Artificial Sequence
  Synthetic Construct
gtgagtggccagcacatct

SEQ ID NO: 35999 - DNA, 21 bp, Artificial Sequence
  Synthetic Construct
gcatttggcatccctgtctga

SEQ ID NO: 36000 - DNA, 27 bp, Artificial Sequence
  Synthetic Construct
ctggagtatagaatctgggagggtaag

SEQ ID NO: 36001 - DNA, 19 bp, Artificial Sequence
  Synthetic Construct
acccagccccgtctgaatg

SEQ ID NO: 36002 - DNA, 20 bp, Artificial Sequence
  Synthetic Construct
aggaccccagcgtgctccat

SEQ ID NO: 36003 - DNA, 27 bp, Artificial Sequence
  Synthetic Construct
ctatgcttataaaacctgacccagttc

SEQ ID NO: 36004 - DNA, 21 bp, Artificial Sequence
  Synthetic Construct
tccagagcacccctcctcaaa

SEQ ID NO: 36005 - DNA, 18 bp, Artificial Sequence
  Synthetic Construct
agcaggggccactactgt

SEQ ID NO: 36006 - DNA, 21 bp, Artificial Sequence
  Synthetic Construct
cgggttcctggtgctcatctt

SEQ ID NO: 36007 - DNA, 22 bp, Artificial Sequence
  Synthetic Construct
ctaggagcagagatgcgacttc

SEQ ID NO: 36008 - DNA, 21 bp, Artificial Sequence
  Synthetic Construct
tcccgggaacatgctgcattc

SEQ ID NO: 36009 - DNA, 22 bp, Artificial Sequence
  Synthetic Construct
gctttgaggaggatgggtggta

SEQ ID NO: 36010 - DNA, 21 bp, Artificial Sequence
  Synthetic Construct
gcagaagccactggcagaaac

SEQ ID NO: 36011 - DNA, 25 bp, Artificial Sequence
  Synthetic Construct
cctaggacattaagggaacatggaa

SEQ ID NO: 36012 - DNA, 23 bp, Artificial Sequence
  Synthetic Construct
gctatgttgttccaggcctctgt

SEQ ID NO: 36013 - DNA, 19 bp, Artificial Sequence
  Synthetic Construct
tccctgtccccacgcagtt

SEQ ID NO: 36014 - DNA, 25 bp, Artificial Sequence
  Synthetic Construct
ggtcttcgactctccaaggaacaga

SEQ ID NO: 36015 - DNA, 22 bp, Artificial Sequence
  Synthetic Construct
gcccaggcccatgaattactgt

SEQ ID NO: 36016 - DNA, 20 bp, Artificial Sequence
  Synthetic Construct
ggcacccatttggtcactgt

SEQ ID NO: 36017 - DNA, 20 bp, Artificial Sequence
  Synthetic Construct
ttggccagcgcaactggaaa

SEQ ID NO: 36018 - DNA, 20 bp, Artificial Sequence
  Synthetic Construct
gtaggtctggggcaggaaga

SEQ ID NO: 36019 - DNA, 20 bp, Artificial Sequence
  Synthetic Construct
atgcccagagcacccactgt

SEQ ID NO: 36020 - DNA, 25 bp, Artificial Sequence
  Synthetic Construct
gcttatggagcaaaggatcggtgat

SEQ ID NO: 36021 - DNA, 20 bp, Artificial Sequence
  Synthetic Construct
tctgccccttaccccaggat

SEQ ID NO: 36022 - DNA, 18 bp, Artificial Sequence
  Synthetic Construct
tgcttgctgtgcccaagt

SEQ ID NO: 36023 - DNA, 22 bp, Artificial Sequence
  Synthetic Construct
ggacaggaagcacagcaggttt

SEQ ID NO: 36024 - DNA, 23 bp, Artificial Sequence
  Synthetic Construct
ggcccaaagtgagcatttacatc

SEQ ID NO: 36025 - DNA, 20 bp, Artificial Sequence
  Synthetic Construct
gcagagggaacagaggcttt

SEQ ID NO: 36026 - DNA, 22 bp, Artificial Sequence
  Synthetic Construct
gcgtggctacagagaagtgaga

SEQ ID NO: 36027 - DNA, 22 bp, Artificial Sequence
  Synthetic Construct
cctgctccctgcagtatctttc

SEQ ID NO: 36028 - DNA, 20 bp, Artificial Sequence
  Synthetic Construct
agaggctggtgtccccatag

SEQ ID NO: 36029 - DNA, 20 bp, Artificial Sequence
  Synthetic Construct
taggggtcctacgtgcagaa

SEQ ID NO: 36030 - DNA, 25 bp, Artificial Sequence
  Synthetic Construct
tcagggcacagagatataagaggtt

SEQ ID NO: 36031 - DNA, 22 bp, Artificial Sequence
  Synthetic Construct
tccagcctcgcttctgagctat

SEQ ID NO: 36032 - DNA, 20 bp, Artificial Sequence
  Synthetic Construct
acacgaccacgtggaactca

SEQ ID NO: 36033 - DNA, 21 bp, Artificial Sequence
  Synthetic Construct
tcagtctgccggacaccattg

SEQ ID NO: 36034 - DNA, 18 bp, Artificial Sequence
  Synthetic Construct
ttgcccacgcagtgttga

SEQ ID NO: 36035 - DNA, 22 bp, Artificial Sequence
  Synthetic Construct
ccagatcctgcctgctcttcaa

SEQ ID NO: 36036 - DNA, 27 bp, Artificial Sequence
  Synthetic Construct
gccttatggactgtgatgtcctcagaa

SEQ ID NO: 36037 - DNA, 24 bp, Artificial Sequence
  Synthetic Construct
gagatgggatttcgtgacccattg

SEQ ID NO: 36038 - DNA, 21 bp, Artificial Sequence
  Synthetic Construct
tcctgcccatagccccagaaa

SEQ ID NO: 36039 - DNA, 21 bp, Artificial Sequence
  Synthetic Construct
ttggtgggagcccgttccttt

SEQ ID NO: 36040 - DNA, 24 bp, Artificial Sequence
  Synthetic Construct
cctgccagaaaacttaccccagta

SEQ ID NO: 36041 - DNA, 19 bp, Artificial Sequence
  Synthetic Construct
atccctcccagccacaact

SEQ ID NO: 36042 - DNA, 20 bp, Artificial Sequence
  Synthetic Construct
gcaaaccttaccgccacagt

SEQ ID NO: 36043 - DNA, 21 bp, Artificial Sequence
  Synthetic Construct
catgccattctagcccagcaa

SEQ ID NO: 36044 - DNA, 23 bp, Artificial Sequence
  Synthetic Construct
ggtgcataaatgaggctgcttgt

SEQ ID NO: 36045 - DNA, 24 bp, Artificial Sequence
  Synthetic Construct
gattggtatctggaggaggacaag

SEQ ID NO: 36046 - DNA, 28 bp, Artificial Sequence
  Synthetic Construct
ccctgtggggtacagtattttcatggat

SEQ ID NO: 36047 - DNA, 26 bp, Artificial Sequence
  Synthetic Construct
gacactaccctgaaatcctcttgcta

SEQ ID NO: 36048 - DNA, 22 bp, Artificial Sequence
  Synthetic Construct
tccccacctcctaaagcacagt

SEQ ID NO: 36049 - DNA, 26 bp, Artificial Sequence
  Synthetic Construct
ccaaggattttctcctctcctcagat

SEQ ID NO: 36050 - DNA, 21 bp, Artificial Sequence
  Synthetic Construct
aagtggtggctcctgtagaga

SEQ ID NO: 36051 - DNA, 24 bp, Artificial Sequence
  Synthetic Construct
tggtgattctccaagacctactgt

SEQ ID NO: 36052 - DNA, 24 bp, Artificial Sequence
  Synthetic Construct
ggatgtgatttgctggagcgttga

SEQ ID NO: 36053 - DNA, 22 bp, Artificial Sequence
  Synthetic Construct
cacagatctggccctgtcaatc

SEQ ID NO: 36054 - DNA, 24 bp, Artificial Sequence
  Synthetic Construct
ccttgaacatgcacttgagtctct

SEQ ID NO: 36055 - DNA, 20 bp, Artificial Sequence
  Synthetic Construct
aggggtgggtgtgccctctt

SEQ ID NO: 36056 - DNA, 22 bp, Artificial Sequence
  Synthetic Construct
gcacacaagaggggaacctaac

SEQ ID NO: 36057 - DNA, 26 bp, Artificial Sequence
  Synthetic Construct
gggccttgatggtaataggaaacaga

SEQ ID NO: 36058 - DNA, 25 bp, Artificial Sequence
  Synthetic Construct
aagtcaagctggaacatagagttga

SEQ ID NO: 36059 - DNA, 20 bp, Artificial Sequence
  Synthetic Construct
ggaccctttccagcagcttt

SEQ ID NO: 36060 - DNA, 23 bp, Artificial Sequence
  Synthetic Construct
cctcccctttatgagcaggacaa

SEQ ID NO: 36061 - DNA, 22 bp, Artificial Sequence
  Synthetic Construct
gcaaaacaccctgagccaatag

SEQ ID NO: 36062 - DNA, 21 bp, Artificial Sequence
  Synthetic Construct
ttactcctccaccgcactttc

SEQ ID NO: 36063 - DNA, 22 bp, Artificial Sequence
  Synthetic Construct
gggcccttcacacacatacctt

SEQ ID NO: 36064 - DNA, 22 bp, Artificial Sequence
  Synthetic Construct
gccactataccccgacctcttg

SEQ ID NO: 36065 - DNA, 22 bp, Artificial Sequence
  Synthetic Construct
cgatctcactgggagctgtaga

SEQ ID NO: 36066 - DNA, 26 bp, Artificial Sequence
  Synthetic Construct
ggcagaatttttgatgaaggggaaac

SEQ ID NO: 36067 - DNA, 22 bp, Artificial Sequence
  Synthetic Construct
ggctgtcgcatgatggttgtct

SEQ ID NO: 36068 - DNA, 23 bp, Artificial Sequence
  Synthetic Construct
cccctccagggaaattgggattg

SEQ ID NO: 36069 - DNA, 20 bp, Artificial Sequence
  Synthetic Construct
agccaccatgcctggcctaa

SEQ ID NO: 36070 - DNA, 25 bp, Artificial Sequence
  Synthetic Construct
tcatcatgaggttctgacgttttct

SEQ ID NO: 36071 - DNA, 29 bp, Artificial Sequence
  Synthetic Construct
gcaagtgtaccttaaagtgagtcatcaga

SEQ ID NO: 36072 - DNA, 23 bp, Artificial Sequence
  Synthetic Construct
ttcttgccttggttcatcgtact

SEQ ID NO: 36073 - DNA, 22 bp, Artificial Sequence
  Synthetic Construct
gtggagggtctctatgctcact

SEQ ID NO: 36074 - DNA, 23 bp, Artificial Sequence
  Synthetic Construct
cccagaaggagaactgggtcaga

SEQ ID NO: 36075 - DNA, 21 bp, Artificial Sequence
  Synthetic Construct
agctttagccctgccctcctt

SEQ ID NO: 36076 - DNA, 25 bp, Artificial Sequence
  Synthetic Construct
ggcatatttgaaatgctggcaggta

SEQ ID NO: 36077 - DNA, 21 bp, Artificial Sequence
  Synthetic Construct
gcagagctgcaactgggctat

SEQ ID NO: 36078 - DNA, 18 bp, Artificial Sequence
  Synthetic Construct
aggctgctgagggacaca

SEQ ID NO: 36079 - DNA, 21 bp, Artificial Sequence
  Synthetic Construct
cagacgcagaatgagctccaa

SEQ ID NO: 36080 - DNA, 22 bp, Artificial Sequence
  Synthetic Construct
tggaaggagcaagtttgcatgt

SEQ ID NO: 36081 - DNA, 27 bp, Artificial Sequence
  Synthetic Construct
cacccatggaacaatacaagacatgat

SEQ ID NO: 36082 - DNA, 24 bp, Artificial Sequence
  Synthetic Construct
gctttcttctgccaggaaggtcaa

SEQ ID NO: 36083 - DNA, 24 bp, Artificial Sequence
  Synthetic Construct
tcttggaaagctgttgtagcttgt

SEQ ID NO: 36084 - DNA, 24 bp, Artificial Sequence
  Synthetic Construct
gagaacatcagaggctgtgtgaag

SEQ ID NO: 36085 - DNA, 26 bp, Artificial Sequence
  Synthetic Construct
cagcctcaattacagcagaagctaac

SEQ ID NO: 36086 - DNA, 26 bp, Artificial Sequence
  Synthetic Construct
caagtgaggtatcacttcccaaaaag

SEQ ID NO: 36087 - DNA, 19 bp, Artificial Sequence
  Synthetic Construct
ggcagctgtggagcacttc

SEQ ID NO: 36088 - DNA, 24 bp, Artificial Sequence
  Synthetic Construct
gtggagcctctccaaattgtgttg

SEQ ID NO: 36089 - DNA, 20 bp, Artificial Sequence
  Synthetic Construct
tgaatggggccatggtgagt

SEQ ID NO: 36090 - DNA, 30 bp, Artificial Sequence
  Synthetic Construct
ggacagaagttataaggagctaggatttag

SEQ ID NO: 36091 - DNA, 25 bp, Artificial Sequence
  Synthetic Construct
gtggtaggactgctgtttatcagtt

SEQ ID NO: 36092 - DNA, 21 bp, Artificial Sequence
  Synthetic Construct
gggaatggttgccagtacctt

SEQ ID NO: 36093 - DNA, 21 bp, Artificial Sequence
  Synthetic Construct
ggcctcactgctgccttcata

SEQ ID NO: 36094 - DNA, 25 bp, Artificial Sequence
  Synthetic Construct
tgttcaaacagaaccctacttggaa

SEQ ID NO: 36095 - DNA, 21 bp, Artificial Sequence
  Synthetic Construct
aaagactgcaccaagctggaa

SEQ ID NO: 36096 - DNA, 21 bp, Artificial Sequence
  Synthetic Construct
tgtctgcagagggactgaaac

SEQ ID NO: 36097 - DNA, 19 bp, Artificial Sequence
  Synthetic Construct
cgcacgatccgagggagat

SEQ ID NO: 36098 - DNA, 23 bp, Artificial Sequence
  Synthetic Construct
catcttgctgtaaccaccacagt

SEQ ID NO: 36099 - DNA, 20 bp, Artificial Sequence
  Synthetic Construct
agggcagagatggggaaaca

SEQ ID NO: 36100 - DNA, 22 bp, Artificial Sequence
  Synthetic Construct
gtgtgggtgtgtgtcagcatag

SEQ ID NO: 36101 - DNA, 24 bp, Artificial Sequence
  Synthetic Construct
gcactagggatctctggaaacctt

SEQ ID NO: 36102 - DNA, 25 bp, Artificial Sequence
  Synthetic Construct
gccctagatgaagaggttcccacta

SEQ ID NO: 36103 - DNA, 22 bp, Artificial Sequence
  Synthetic Construct
caatgtgactggggtgttgaga

SEQ ID NO: 36104 - DNA, 25 bp, Artificial Sequence
  Synthetic Construct
ggcaggaatgcaaccaaggacatga

SEQ ID NO: 36105 - DNA, 23 bp, Artificial Sequence
  Synthetic Construct
cacagactggcttaggacctatc

SEQ ID NO: 36106 - DNA, 20 bp, Artificial Sequence
  Synthetic Construct
tctgggccaccaggaagtga

SEQ ID NO: 36107 - DNA, 22 bp, Artificial Sequence
  Synthetic Construct
gaggtaagccagaggaaacgaa

SEQ ID NO: 36108 - DNA, 22 bp, Artificial Sequence
  Synthetic Construct
aacgtggagggtcagaggtttg

SEQ ID NO: 36109 - DNA, 23 bp, Artificial Sequence
  Synthetic Construct
cagatggctaatggcacagcatt

SEQ ID NO: 36110 - DNA, 22 bp, Artificial Sequence
  Synthetic Construct
agcagattcagagcgagacatc

SEQ ID NO: 36111 - DNA, 20 bp, Artificial Sequence
  Synthetic Construct
cttggcctctaaggctgctt

SEQ ID NO: 36112 - DNA, 22 bp, Artificial Sequence
  Synthetic Construct
cgcttccacacaccaaggaatg

SEQ ID NO: 36113 - DNA, 26 bp, Artificial Sequence
  Synthetic Construct
gcaactcactcctcttcctaagaaat

SEQ ID NO: 36114 - DNA, 22 bp, Artificial Sequence
  Synthetic Construct
ggcttcgagattcagtccacaa

SEQ ID NO: 36115 - DNA, 22 bp, Artificial Sequence
  Synthetic Construct
ggacccagcaacaacagcaaga

SEQ ID NO: 36116 - DNA, 22 bp, Artificial Sequence
  Synthetic Construct
agcccttcctccacctcatttg

SEQ ID NO: 36117 - DNA, 22 bp, Artificial Sequence
  Synthetic Construct
tcaggtgtgaaggtgcctctct

SEQ ID NO: 36118 - DNA, 18 bp, Artificial Sequence
  Synthetic Construct
agcggcatccctgtcctt

SEQ ID NO: 36119 - DNA, 20 bp, Artificial Sequence
  Synthetic Construct
acctctgtgccaggtcagtt

SEQ ID NO: 36120 - DNA, 23 bp, Artificial Sequence
  Synthetic Construct
gggaccgctgagattatgccaat

SEQ ID NO: 36121 - DNA, 26 bp, Artificial Sequence
  Synthetic Construct
cgtagaccttctcagatgccactact

SEQ ID NO: 36122 - DNA, 20 bp, Artificial Sequence
  Synthetic Construct
cccatgagttggccgtgttt

SEQ ID NO: 36123 - DNA, 18 bp, Artificial Sequence
  Synthetic Construct
aggtcctgccgaggtcat

SEQ ID NO: 36124 - DNA, 21 bp, Artificial Sequence
  Synthetic Construct
ggtgtgacttaggcccactgt

SEQ ID NO: 36125 - DNA, 22 bp, Artificial Sequence
  Synthetic Construct
gctctaccctcctgtccctcaa

SEQ ID NO: 36126 - DNA, 22 bp, Artificial Sequence
  Synthetic Construct
cagagccaggccttctcttaaa

SEQ ID NO: 36127 - DNA, 18 bp, Artificial Sequence
  Synthetic Construct
aggaatgcggggcactca

SEQ ID NO: 36128 - DNA, 25 bp, Artificial Sequence
  Synthetic Construct
ctatctgaggcaaacagaccctatc

SEQ ID NO: 36129 - DNA, 20 bp, Artificial Sequence
  Synthetic Construct
tgcctcctcacagcctcctt

SEQ ID NO: 36130 - DNA, 22 bp, Artificial Sequence
  Synthetic Construct
gggtgctcgagattccaccata

SEQ ID NO: 36131 - DNA, 22 bp, Artificial Sequence
  Synthetic Construct
tttcctgaaacacaggcagaca

SEQ ID NO: 36132 - DNA, 20 bp, Artificial Sequence
  Synthetic Construct
gcccacaaagggtggtgaaa

SEQ ID NO: 36133 - DNA, 20 bp, Artificial Sequence
  Synthetic Construct
gcttgcttgcttgcttgctt

SEQ ID NO: 36134 - DNA, 22 bp, Artificial Sequence
  Synthetic Construct
gctaggcaaaggcttgtagctt

SEQ ID NO: 36135 - DNA, 23 bp, Artificial Sequence
  Synthetic Construct
ggatgacttggtcaccctgttct

SEQ ID NO: 36136 - DNA, 24 bp, Artificial Sequence
  Synthetic Construct
gagagtttcaccctgtctgtctca

SEQ ID NO: 36137 - DNA, 21 bp, Artificial Sequence
  Synthetic Construct
cccacaaaggccatgggacat

SEQ ID NO: 36138 - DNA, 21 bp, Artificial Sequence
  Synthetic Construct
tcggccaagaacagggaaatc

SEQ ID NO: 36139 - DNA, 19 bp, Artificial Sequence
  Synthetic Construct
aggacaggtgaccgtgagt

SEQ ID NO: 36140 - DNA, 22 bp, Artificial Sequence
  Synthetic Construct
cctgcaggcagggagatttatt

SEQ ID NO: 36141 - DNA, 20 bp, Artificial Sequence
  Synthetic Construct
tgtgcttcggggaggtgata

SEQ ID NO: 36142 - DNA, 20 bp, Artificial Sequence
  Synthetic Construct
cagggatgtgcatggcaact

SEQ ID NO: 36143 - DNA, 23 bp, Artificial Sequence
  Synthetic Construct
gagcagcttccatcgttttctgt

SEQ ID NO: 36144 - DNA, 23 bp, Artificial Sequence
  Synthetic Construct
cagagatccaactgtccccattg

SEQ ID NO: 36145 - DNA, 23 bp, Artificial Sequence
  Synthetic Construct
cctggagagcttggtgtttggat

SEQ ID NO: 36146 - DNA, 24 bp, Artificial Sequence
  Synthetic Construct
gagcaacattgcattccagtgtga

SEQ ID NO: 36147 - DNA, 18 bp, Artificial Sequence
  Synthetic Construct
agctcccctggcccaaat

SEQ ID NO: 36148 - DNA, 25 bp, Artificial Sequence
  Synthetic Construct
ggcttatattcccttcatggtgcta

SEQ ID NO: 36149 - DNA, 22 bp, Artificial Sequence
  Synthetic Construct
gaggggcagataaggacagagt

SEQ ID NO: 36150 - DNA, 22 bp, Artificial Sequence
  Synthetic Construct
caggcaggggtgtgttgttact

SEQ ID NO: 36151 - DNA, 27 bp, Artificial Sequence
  Synthetic Construct
tccccatcctagattttctacttcttg

SEQ ID NO: 36152 - DNA, 22 bp, Artificial Sequence
  Synthetic Construct
aatgtagtgtgagcgagcaaga

SEQ ID NO: 36153 - DNA, 23 bp, Artificial Sequence
  Synthetic Construct
ggagaacgtgatgccctatttct

SEQ ID NO: 36154 - DNA, 20 bp, Artificial Sequence
  Synthetic Construct
tgtggaaagaggggccaaga

SEQ ID NO: 36155 - DNA, 22 bp, Artificial Sequence
  Synthetic Construct
tgtctgaagccagtaggctttg

SEQ ID NO: 36156 - DNA, 25 bp, Artificial Sequence
  Synthetic Construct
caacatgaatcagatgcggtcattc

SEQ ID NO: 36157 - DNA, 25 bp, Artificial Sequence
  Synthetic Construct
ggaaacatctccctttcctccttga

SEQ ID NO: 36158 - DNA, 21 bp, Artificial Sequence
  Synthetic Construct
ttggtttcccctgggctcctt

SEQ ID NO: 36159 - DNA, 21 bp, Artificial Sequence
  Synthetic Construct
tcagcacccggggtattctca

SEQ ID NO: 36160 - DNA, 20 bp, Artificial Sequence
  Synthetic Construct
gcacaggcaagagcaagagt

SEQ ID NO: 36161 - DNA, 25 bp, Artificial Sequence
  Synthetic Construct
cttcacattaaattgtgggctcctt

SEQ ID NO: 36162 - DNA, 23 bp, Artificial Sequence
  Synthetic Construct
gtgggagttggattcttcctgtt

SEQ ID NO: 36163 - DNA, 23 bp, Artificial Sequence
  Synthetic Construct
gggcagtatgtacaaggatgtgt

SEQ ID NO: 36164 - DNA, 25 bp, Artificial Sequence
  Synthetic Construct
acacaatctcttctcgatccacttt

SEQ ID NO: 36165 - DNA, 22 bp, Artificial Sequence
  Synthetic Construct
ggcagcacagagtggttgttac

SEQ ID NO: 36166 - DNA, 24 bp, Artificial Sequence
  Synthetic Construct
ctggcaacatatcactgagcaagt

SEQ ID NO: 36167 - DNA, 20 bp, Artificial Sequence
  Synthetic Construct
cgggtggggaaacaggctta

SEQ ID NO: 36168 - DNA, 22 bp, Artificial Sequence
  Synthetic Construct
tcgggctttggagtctgtctga

SEQ ID NO: 36169 - DNA, 21 bp, Artificial Sequence
  Synthetic Construct
tgcagatcacacgaccaggta

SEQ ID NO: 36170 - DNA, 20 bp, Artificial Sequence
  Synthetic Construct
ccgtcccaaactgcttgttg

SEQ ID NO: 36171 - DNA, 18 bp, Artificial Sequence
  Synthetic Construct
atccggcctgcaggtaca

SEQ ID NO: 36172 - DNA, 26 bp, Artificial Sequence
  Synthetic Construct
aggatggagctatcagtatcatcaga

SEQ ID NO: 36173 - DNA, 26 bp, Artificial Sequence
  Synthetic Construct
ggacaaaggtaggtgagaaccactct

SEQ ID NO: 36174 - DNA, 24 bp, Artificial Sequence
  Synthetic Construct
gggtgaattctgaatggtgctgaa

SEQ ID NO: 36175 - DNA, 20 bp, Artificial Sequence
  Synthetic Construct
tcgagtccggctcccactca

SEQ ID NO: 36176 - DNA, 22 bp, Artificial Sequence
  Synthetic Construct
ggcaggactggtccttgaaaag

SEQ ID NO: 36177 - DNA, 23 bp, Artificial Sequence
  Synthetic Construct
cctcactctcacctcccaaccta

SEQ ID NO: 36178 - DNA, 24 bp, Artificial Sequence
  Synthetic Construct
atgcccatgtttgaagtacagaga

SEQ ID NO: 36179 - DNA, 22 bp, Artificial Sequence
  Synthetic Construct
tccctcctgccaggtctttatg

SEQ ID NO: 36180 - DNA, 23 bp, Artificial Sequence
  Synthetic Construct
cccctgcagattcacaggacttt

SEQ ID NO: 36181 - DNA, 22 bp, Artificial Sequence
  Synthetic Construct
agccctgcctttctcttacaac

SEQ ID NO: 36182 - DNA, 19 bp, Artificial Sequence
  Synthetic Construct
ttgtcccactgcggggtta

SEQ ID NO: 36183 - DNA, 26 bp, Artificial Sequence
  Synthetic Construct
accactcaagactatagacctacaca

SEQ ID NO: 36184 - DNA, 22 bp, Artificial Sequence
  Synthetic Construct
gcagtgtaacaaagtgccaact

SEQ ID NO: 36185 - DNA, 22 bp, Artificial Sequence
  Synthetic Construct
ccagttcctgttgccactcttc

SEQ ID NO: 36186 - DNA, 19 bp, Artificial Sequence
  Synthetic Construct
ctggctggagctcccctaa

SEQ ID NO: 36187 - DNA, 21 bp, Artificial Sequence
  Synthetic Construct
tagtgtgctggctgggaggat

SEQ ID NO: 36188 - DNA, 20 bp, Artificial Sequence
  Synthetic Construct
aagctgcctcccctctcatt

SEQ ID NO: 36189 - DNA, 25 bp, Artificial Sequence
  Synthetic Construct
ctgtgctcatgaatttgtcttccaa

SEQ ID NO: 36190 - DNA, 24 bp, Artificial Sequence
  Synthetic Construct
gggagaacctaggctatggagtca

SEQ ID NO: 36191 - DNA, 25 bp, Artificial Sequence
  Synthetic Construct
cactccatactggctcaaagacatt

SEQ ID NO: 36192 - DNA, 23 bp, Artificial Sequence
  Synthetic Construct
ggctggtgaagtctgaggtcttg

SEQ ID NO: 36193 - DNA, 26 bp, Artificial Sequence
  Synthetic Construct
gatcacagaaccaggaaaaggaaaac

SEQ ID NO: 36194 - DNA, 20 bp, Artificial Sequence
  Synthetic Construct
gccctgtgggtggccataaa

SEQ ID NO: 36195 - DNA, 27 bp, Artificial Sequence
  Synthetic Construct
ccacaaacaaagcgggctaaaatcctt

SEQ ID NO: 36196 - DNA, 24 bp, Artificial Sequence
  Synthetic Construct
cagggtcatgtctcatgcacaaag

SEQ ID NO: 36197 - DNA, 24 bp, Artificial Sequence
  Synthetic Construct
gcgagacctgattacagggagtgt

SEQ ID NO: 36198 - DNA, 26 bp, Artificial Sequence
  Synthetic Construct
gtctagttgatctccaagaccctttc

SEQ ID NO: 36199 - DNA, 19 bp, Artificial Sequence
  Synthetic Construct
aattgcgctgggcagtagt

SEQ ID NO: 36200 - DNA, 21 bp, Artificial Sequence
  Synthetic Construct
ggcagtgcaatgtctgtctgt

SEQ ID NO: 36201 - DNA, 19 bp, Artificial Sequence
  Synthetic Construct
tgaggggcctgagcctctt

SEQ ID NO: 36202 - DNA, 28 bp, Artificial Sequence
  Synthetic Construct
gcctacataagataagcagtctgacatc

SEQ ID NO: 36203 - DNA, 21 bp, Artificial Sequence
  Synthetic Construct
ggacttccctcaccacagctt

SEQ ID NO: 36204 - DNA, 27 bp, Artificial Sequence
  Synthetic Construct
acaccaaagagatattggaggaagaag

SEQ ID NO: 36205 - DNA, 20 bp, Artificial Sequence
  Synthetic Construct
gctgcccgaaaggattctga

SEQ ID NO: 36206 - DNA, 22 bp, Artificial Sequence
  Synthetic Construct
gcgctcgtaggtcatggctatc

SEQ ID NO: 36207 - DNA, 23 bp, Artificial Sequence
  Synthetic Construct
ggacatcagatctgggccttgaa

SEQ ID NO: 36208 - DNA, 20 bp, Artificial Sequence
  Synthetic Construct
tgggacacctcagctcacaa

SEQ ID NO: 36209 - DNA, 23 bp, Artificial Sequence
  Synthetic Construct
cccttttgtttttccaggtggtt

SEQ ID NO: 36210 - DNA, 19 bp, Artificial Sequence
  Synthetic Construct
tggtgaacgcctgcatcat

SEQ ID NO: 36211 - DNA, 25 bp, Artificial Sequence
  Synthetic Construct
ggtctgtctgatagcaagtttgtgt

SEQ ID NO: 36212 - DNA, 25 bp, Artificial Sequence
  Synthetic Construct
ctgtgtcactgatgaaagggagaga

SEQ ID NO: 36213 - DNA, 22 bp, Artificial Sequence
  Synthetic Construct
gcgtggctgctggttactgtat

SEQ ID NO: 36214 - DNA, 22 bp, Artificial Sequence
  Synthetic Construct
ggattctgggactggcagaaag

SEQ ID NO: 36215 - DNA, 23 bp, Artificial Sequence
  Synthetic Construct
cctgtattctgcagcgttctcaa

SEQ ID NO: 36216 - DNA, 28 bp, Artificial Sequence
  Synthetic Construct
ggctttcccactgtcttaattccagcaa

SEQ ID NO: 36217 - DNA, 23 bp, Artificial Sequence
  Synthetic Construct
catctgccctgagagatgggtat

SEQ ID NO: 36218 - DNA, 20 bp, Artificial Sequence
  Synthetic Construct
tgcgaccctgtgggcagaat

SEQ ID NO: 36219 - DNA, 20 bp, Artificial Sequence
  Synthetic Construct
cacctgatcacagcgggttt

SEQ ID NO: 36220 - DNA, 22 bp, Artificial Sequence
  Synthetic Construct
cgacacagtgggaagaactgaa

SEQ ID NO: 36221 - DNA, 21 bp, Artificial Sequence
  Synthetic Construct
acccaaccccatcgtctcgtt

SEQ ID NO: 36222 - DNA, 23 bp, Artificial Sequence
  Synthetic Construct
tgacaaactgatcctggcacttg

SEQ ID NO: 36223 - DNA, 22 bp, Artificial Sequence
  Synthetic Construct
cctacctgctggtgtcttggtt

SEQ ID NO: 36224 - DNA, 22 bp, Artificial Sequence
  Synthetic Construct
ccccttagggattcctgcacta

SEQ ID NO: 36225 - DNA, 26 bp, Artificial Sequence
  Synthetic Construct
gcccagacaagactcattccatcctt

SEQ ID NO: 36226 - DNA, 19 bp, Artificial Sequence
  Synthetic Construct
tgggcttctggggcaaaaa

SEQ ID NO: 36227 - DNA, 22 bp, Artificial Sequence
  Synthetic Construct
gcaactaaccaccctccagatg

SEQ ID NO: 36228 - DNA, 23 bp, Artificial Sequence
  Synthetic Construct
ggtgggtatctccagaacagctt

SEQ ID NO: 36229 - DNA, 21 bp, Artificial Sequence
  Synthetic Construct
gctggctgaagctcagtggtt

SEQ ID NO: 36230 - DNA, 20 bp, Artificial Sequence
  Synthetic Construct
ggggtttcagcggactgtga

SEQ ID NO: 36231 - DNA, 22 bp, Artificial Sequence
  Synthetic Construct
agcctctgccttgagagacaac

SEQ ID NO: 36232 - DNA, 23 bp, Artificial Sequence
  Synthetic Construct
gctggctgatggactggtagtct

SEQ ID NO: 36233 - DNA, 24 bp, Artificial Sequence
  Synthetic Construct
gggacacactaactgctcaaccaa

SEQ ID NO: 36234 - DNA, 22 bp, Artificial Sequence
  Synthetic Construct
gcaacacacagcctggacattc

SEQ ID NO: 36235 - DNA, 27 bp, Artificial Sequence
  Synthetic Construct
gccatatcttgttcaagggaggctgaa

SEQ ID NO: 36236 - DNA, 24 bp, Artificial Sequence
  Synthetic Construct
gctgacttggaattgttcacttgt

SEQ ID NO: 36237 - DNA, 20 bp, Artificial Sequence
  Synthetic Construct
gcgtccttccccagttgaca

SEQ ID NO: 36238 - DNA, 22 bp, Artificial Sequence
  Synthetic Construct
cagatggcccaacttggtgatg

SEQ ID NO: 36239 - DNA, 21 bp, Artificial Sequence
  Synthetic Construct
aagctggtggtgcctgcttgt

SEQ ID NO: 36240 - DNA, 20 bp, Artificial Sequence
  Synthetic Construct
cgtttaccaacgggcgaaga

SEQ ID NO: 36241 - DNA, 22 bp, Artificial Sequence
  Synthetic Construct
ggaggcaggaagaagtccacat

SEQ ID NO: 36242 - DNA, 25 bp, Artificial Sequence
  Synthetic Construct
cggtgagtttgtctgcgttcctttc

SEQ ID NO: 36243 - DNA, 22 bp, Artificial Sequence
  Synthetic Construct
accagtccctggtgactcagat

SEQ ID NO: 36244 - DNA, 20 bp, Artificial Sequence
  Synthetic Construct
ggtgaggggtgtgtgtggaa

SEQ ID NO: 36245 - DNA, 22 bp, Artificial Sequence
  Synthetic Construct
acccacccagaggaaggagata

SEQ ID NO: 36246 - DNA, 19 bp, Artificial Sequence
  Synthetic Construct
agccatctgccagccttga

SEQ ID NO: 36247 - DNA, 30 bp, Artificial Sequence
  Synthetic Construct
ggcagatattttaatccacctaacctgtca

SEQ ID NO: 36248 - DNA, 23 bp, Artificial Sequence
  Synthetic Construct
tgtataagggctgcgctgattat

SEQ ID NO: 36249 - DNA, 24 bp, Artificial Sequence
  Synthetic Construct
ggtgctttgaagaccgatgagttc

SEQ ID NO: 36250 - DNA, 24 bp, Artificial Sequence
  Synthetic Construct
ctcctatgtcagccacactgatct

SEQ ID NO: 36251 - DNA, 19 bp, Artificial Sequence
  Synthetic Construct
tgacagtgggagcctcgaa

SEQ ID NO: 36252 - DNA, 23 bp, Artificial Sequence
  Synthetic Construct
ccagttgaaggaggagaaaccaa

SEQ ID NO: 36253 - DNA, 24 bp, Artificial Sequence
  Synthetic Construct
gacagacgaggagaagtcaaacat

SEQ ID NO: 36254 - DNA, 22 bp, Artificial Sequence
  Synthetic Construct
gcaggtcaaccttggctcttac

SEQ ID NO: 36255 - DNA, 22 bp, Artificial Sequence
  Synthetic Construct
cagcagggtcattttccagaga

SEQ ID NO: 36256 - DNA, 27 bp, Artificial Sequence
  Synthetic Construct
gggactcaaaaagtgacatcccagttc

SEQ ID NO: 36257 - DNA, 26 bp, Artificial Sequence
  Synthetic Construct
gcatattctcacattccaccctgaac

SEQ ID NO: 36258 - DNA, 22 bp, Artificial Sequence
  Synthetic Construct
ccctcatcgatgccccttcttt

SEQ ID NO: 36259 - DNA, 22 bp, Artificial Sequence
  Synthetic Construct
ccccaggctaagcagtgacaat

SEQ ID NO: 36260 - DNA, 26 bp, Artificial Sequence
  Synthetic Construct
gtgacagggagctattgaatgactga

SEQ ID NO: 36261 - DNA, 22 bp, Artificial Sequence
  Synthetic Construct
gggtagagcatggcaggaagat

SEQ ID NO: 36262 - DNA, 20 bp, Artificial Sequence
  Synthetic Construct
aggtctgggcttcagtggat

SEQ ID NO: 36263 - DNA, 22 bp, Artificial Sequence
  Synthetic Construct
gccattgcctcctccattgttc

SEQ ID NO: 36264 - DNA, 24 bp, Artificial Sequence
  Synthetic Construct
gtctgaatgaccaggcatctgatt

SEQ ID NO: 36265 - DNA, 26 bp, Artificial Sequence
  Synthetic Construct
ctcataactcctgattgcctggaatg

SEQ ID NO: 36266 - DNA, 22 bp, Artificial Sequence
  Synthetic Construct
gcggtaggattggtctgggaat

SEQ ID NO: 36267 - DNA, 25 bp, Artificial Sequence
  Synthetic Construct
cctgaggcataaccagttgatcttg

SEQ ID NO: 36268 - DNA, 20 bp, Artificial Sequence
  Synthetic Construct
tctgtcgctttgggctcttc

SEQ ID NO: 36269 - DNA, 25 bp, Artificial Sequence
  Synthetic Construct
cagactgtaaagtgaaacccctgtt

SEQ ID NO: 36270 - DNA, 22 bp, Artificial Sequence
  Synthetic Construct
tgggccataagaggctggtcta

SEQ ID NO: 36271 - DNA, 26 bp, Artificial Sequence
  Synthetic Construct
ctctgtcaatttggggctaaagtcat

SEQ ID NO: 36272 - DNA, 20 bp, Artificial Sequence
  Synthetic Construct
tggctcctctgccccattga

SEQ ID NO: 36273 - DNA, 20 bp, Artificial Sequence
  Synthetic Construct
tgtggcaggggacaccttct

SEQ ID NO: 36274 - DNA, 20 bp, Artificial Sequence
  Synthetic Construct
gtggtggcggagacacaaaa

SEQ ID NO: 36275 - DNA, 26 bp, Artificial Sequence
  Synthetic Construct
tctcctcttctttgagctagcagtat

SEQ ID NO: 36276 - DNA, 21 bp, Artificial Sequence
  Synthetic Construct
tgtgtacctggagggcacaag

SEQ ID NO: 36277 - DNA, 20 bp, Artificial Sequence
  Synthetic Construct
gctggatggccacattgaac

SEQ ID NO: 36278 - DNA, 21 bp, Artificial Sequence
  Synthetic Construct
cacctggcctgaggagagaat

SEQ ID NO: 36279 - DNA, 22 bp, Artificial Sequence
  Synthetic Construct
ccacgagttaggggagactttg

SEQ ID NO: 36280 - DNA, 23 bp, Artificial Sequence
  Synthetic Construct
ctggaaaaatgcccgggaacaag

SEQ ID NO: 36281 - DNA, 20 bp, Artificial Sequence
  Synthetic Construct
caactctggctgctcggtaa

SEQ ID NO: 36282 - DNA, 26 bp, Artificial Sequence
  Synthetic Construct
cccaataaaatggcctctgaaacctt

SEQ ID NO: 36283 - DNA, 22 bp, Artificial Sequence
  Synthetic Construct
cctaccagccacaattccttct

SEQ ID NO: 36284 - DNA, 26 bp, Artificial Sequence
  Synthetic Construct
gctaaattgatttccttgccctccaa

SEQ ID NO: 36285 - DNA, 22 bp, Artificial Sequence
  Synthetic Construct
gcctccctgctacttgagcaaa

SEQ ID NO: 36286 - DNA, 27 bp, Artificial Sequence
  Synthetic Construct
ggggtagttggtgtagacagaaacctt

SEQ ID NO: 36287 - DNA, 20 bp, Artificial Sequence
  Synthetic Construct
tctgactgcctgaggtggaa

SEQ ID NO: 36288 - DNA, 22 bp, Artificial Sequence
  Synthetic Construct
cctatccttgggcctggatttg

SEQ ID NO: 36289 - DNA, 20 bp, Artificial Sequence
  Synthetic Construct
tccaccctgggctcctctgt

SEQ ID NO: 36290 - DNA, 21 bp, Artificial Sequence
  Synthetic Construct
agggaggagagaacgtggatt

SEQ ID NO: 36291 - DNA, 25 bp, Artificial Sequence
  Synthetic Construct
caaactggatttgactagcccatct

SEQ ID NO: 36292 - DNA, 24 bp, Artificial Sequence
  Synthetic Construct
atgggactacctggctatagtctt

SEQ ID NO: 36293 - DNA, 22 bp, Artificial Sequence
  Synthetic Construct
ggacacagtctgacccaaggaa

SEQ ID NO: 36294 - DNA, 20 bp, Artificial Sequence
  Synthetic Construct
gtctggacaggagggcttca

SEQ ID NO: 36295 - DNA, 20 bp, Artificial Sequence
  Synthetic Construct
tgggaagggtctcccaaaga

SEQ ID NO: 36296 - DNA, 22 bp, Artificial Sequence
  Synthetic Construct
tctggaggtagggtggatgatg

SEQ ID NO: 36297 - DNA, 20 bp, Artificial Sequence
  Synthetic Construct
agccaagcatggggtagtga

SEQ ID NO: 36298 - DNA, 30 bp, Artificial Sequence
  Synthetic Construct
ccacttcccttcagtataaatcccacaatc

SEQ ID NO: 36299 - DNA, 26 bp, Artificial Sequence
  Synthetic Construct
cctgaaacaggctttaacagggaact

SEQ ID NO: 36300 - DNA, 20 bp, Artificial Sequence
  Synthetic Construct
tggagccctgacctgcttag

SEQ ID NO: 36301 - DNA, 23 bp, Artificial Sequence
  Synthetic Construct
ggtctgggagccagtgtaacttc

SEQ ID NO: 36302 - DNA, 20 bp, Artificial Sequence
  Synthetic Construct
tgtgcatccagagccccatt

SEQ ID NO: 36303 - DNA, 20 bp, Artificial Sequence
  Synthetic Construct
tccaggaggtgcagacacaa

SEQ ID NO: 36304 - DNA, 23 bp, Artificial Sequence
  Synthetic Construct
tgcaaagcttagtacctggcata

SEQ ID NO: 36305 - DNA, 23 bp, Artificial Sequence
  Synthetic Construct
ggagcgcatttaaggggtttttg

SEQ ID NO: 36306 - DNA, 20 bp, Artificial Sequence
  Synthetic Construct
atgcctttcccgtcgctgaa

SEQ ID NO: 36307 - DNA, 20 bp, Artificial Sequence
  Synthetic Construct
ttcacttcccaggggctctt

SEQ ID NO: 36308 - DNA, 22 bp, Artificial Sequence
  Synthetic Construct
tgctgactcaggggtggatctt

SEQ ID NO: 36309 - DNA, 20 bp, Artificial Sequence
  Synthetic Construct
tgacgagatgccagcacaca

SEQ ID NO: 36310 - DNA, 22 bp, Artificial Sequence
  Synthetic Construct
ggccctgtttgccacagaaaag

SEQ ID NO: 36311 - DNA, 24 bp, Artificial Sequence
  Synthetic Construct
gaacagcttcattgagtggtttgt

SEQ ID NO: 36312 - DNA, 23 bp, Artificial Sequence
  Synthetic Construct
atgttaccaatccctcctgcaaa

SEQ ID NO: 36313 - DNA, 22 bp, Artificial Sequence
  Synthetic Construct
catacccgagtgaggcagtatc

SEQ ID NO: 36314 - DNA, 23 bp, Artificial Sequence
  Synthetic Construct
gacctcgctagtctaacccaaac

SEQ ID NO: 36315 - DNA, 27 bp, Artificial Sequence
  Synthetic Construct
gctgaaaaagatggagagttccactca

SEQ ID NO: 36316 - DNA, 20 bp, Artificial Sequence
  Synthetic Construct
gcctcccaaagtgcgtgaac

SEQ ID NO: 36317 - DNA, 22 bp, Artificial Sequence
  Synthetic Construct
tctcactaatgcccctcactgt

SEQ ID NO: 36318 - DNA, 28 bp, Artificial Sequence
  Synthetic Construct
cagagaagggaaagccagtaaatagtgt

SEQ ID NO: 36319 - DNA, 21 bp, Artificial Sequence
  Synthetic Construct
agtgatgcgggtgtccactct

SEQ ID NO: 36320 - DNA, 21 bp, Artificial Sequence
  Synthetic Construct
agaggcgtctccaggactctt

SEQ ID NO: 36321 - DNA, 24 bp, Artificial Sequence
  Synthetic Construct
gtcataaggggctattccgtcagt

SEQ ID NO: 36322 - DNA, 21 bp, Artificial Sequence
  Synthetic Construct
tcaaagctccgggctgtttag

SEQ ID NO: 36323 - DNA, 20 bp, Artificial Sequence
  Synthetic Construct
ggaccgtgaaggcacacaga

SEQ ID NO: 36324 - DNA, 20 bp, Artificial Sequence
  Synthetic Construct
tcccattgcggcagacatca

SEQ ID NO: 36325 - DNA, 21 bp, Artificial Sequence
  Synthetic Construct
aacctgcctgaagcaagacat

SEQ ID NO: 36326 - DNA, 20 bp, Artificial Sequence
  Synthetic Construct
accctggcagtcttgctctt

SEQ ID NO: 36327 - DNA, 20 bp, Artificial Sequence
  Synthetic Construct
ccaggcatgggaaggagaca

SEQ ID NO: 36328 - DNA, 22 bp, Artificial Sequence
  Synthetic Construct
caagtcaagtttgggcccttgt

SEQ ID NO: 36329 - DNA, 29 bp, Artificial Sequence
  Synthetic Construct
cctcatatcaaagtagggtcgatttcatc

SEQ ID NO: 36330 - DNA, 23 bp, Artificial Sequence
  Synthetic Construct
ccacccatctatcccatgcatct

SEQ ID NO: 36331 - DNA, 19 bp, Artificial Sequence
  Synthetic Construct
ttccgccgcccagattgtt

SEQ ID NO: 36332 - DNA, 22 bp, Artificial Sequence
  Synthetic Construct
ggagaatagtccctgccctcaa

SEQ ID NO: 36333 - DNA, 23 bp, Artificial Sequence
  Synthetic Construct
gacttcatgtgatgggtgcattc

SEQ ID NO: 36334 - DNA, 22 bp, Artificial Sequence
  Synthetic Construct
gtcccagctccattccagtaga

SEQ ID NO: 36335 - DNA, 25 bp, Artificial Sequence
  Synthetic Construct
aaagcagtagttcagagtgcctatt

SEQ ID NO: 36336 - DNA, 22 bp, Artificial Sequence
  Synthetic Construct
gtggcaagtcagcccttgtaga

SEQ ID NO: 36337 - DNA, 19 bp, Artificial Sequence
  Synthetic Construct
tacggaggccaagggttca

SEQ ID NO: 36338 - DNA, 22 bp, Artificial Sequence
  Synthetic Construct
tcgtaaaggggcctggacctaa

SEQ ID NO: 36339 - DNA, 24 bp, Artificial Sequence
  Synthetic Construct
ccacctagacttggggcatgatga

SEQ ID NO: 36340 - DNA, 19 bp, Artificial Sequence
  Synthetic Construct
agcctgcagaccccaccaa

SEQ ID NO: 36341 - DNA, 24 bp, Artificial Sequence
  Synthetic Construct
agaacaatttaccgacagccatct

SEQ ID NO: 36342 - DNA, 20 bp, Artificial Sequence
  Synthetic Construct
ggctgcagatggccaggtaa

SEQ ID NO: 36343 - DNA, 19 bp, Artificial Sequence
  Synthetic Construct
tcagggtggctcgggtttg

SEQ ID NO: 36344 - DNA, 22 bp, Artificial Sequence
  Synthetic Construct
cagtcagttcacccctggaaac

SEQ ID NO: 36345 - DNA, 21 bp, Artificial Sequence
  Synthetic Construct
tctgcctgctctgtggaggat

SEQ ID NO: 36346 - DNA, 22 bp, Artificial Sequence
  Synthetic Construct
tcctactgtatgccaggtgcta

SEQ ID NO: 36347 - DNA, 24 bp, Artificial Sequence
  Synthetic Construct
gcagatgtacagtgtttgccactt

SEQ ID NO: 36348 - DNA, 24 bp, Artificial Sequence
  Synthetic Construct
cagttgtaagaggccaagcctaga

SEQ ID NO: 36349 - DNA, 21 bp, Artificial Sequence
  Synthetic Construct
agaggacaggagaccggagaa

SEQ ID NO: 36350 - DNA, 19 bp, Artificial Sequence
  Synthetic Construct
cgggctgcccctcacaaaa

SEQ ID NO: 36351 - DNA, 26 bp, Artificial Sequence
  Synthetic Construct
ggtgatgtctttaatccctcccttag

SEQ ID NO: 36352 - DNA, 23 bp, Artificial Sequence
  Synthetic Construct
gggctataccaatcccagcctat

SEQ ID NO: 36353 - DNA, 21 bp, Artificial Sequence
  Synthetic Construct
ggggctccctggccttaaaaa

SEQ ID NO: 36354 - DNA, 26 bp, Artificial Sequence
  Synthetic Construct
ggaatacaatctgggacaaggacatc

SEQ ID NO: 36355 - DNA, 27 bp, Artificial Sequence
  Synthetic Construct
cccagctaaagtgatacacccttcttg

SEQ ID NO: 36356 - DNA, 21 bp, Artificial Sequence
  Synthetic Construct
agtagctgcatttgccaccat

SEQ ID NO: 36357 - DNA, 24 bp, Artificial Sequence
  Synthetic Construct
ggatgctgggtgttattccagtgt

SEQ ID NO: 36358 - DNA, 25 bp, Artificial Sequence
  Synthetic Construct
gctccccactattatttcccagtta

SEQ ID NO: 36359 - DNA, 24 bp, Artificial Sequence
  Synthetic Construct
gacacactacttcagaagcacctt

SEQ ID NO: 36360 - DNA, 24 bp, Artificial Sequence
  Synthetic Construct
gggagtcccttagtccatgggaaa

SEQ ID NO: 36361 - DNA, 23 bp, Artificial Sequence
  Synthetic Construct
cccaccaatagaagagcctgaac

SEQ ID NO: 36362 - DNA, 20 bp, Artificial Sequence
  Synthetic Construct
tgcctccgccagctaaaaca

SEQ ID NO: 36363 - DNA, 20 bp, Artificial Sequence
  Synthetic Construct
acctaacaccccagcagaca

SEQ ID NO: 36364 - DNA, 21 bp, Artificial Sequence
  Synthetic Construct
gggctaaatgtaggcccagtt

SEQ ID NO: 36365 - DNA, 19 bp, Artificial Sequence
  Synthetic Construct
cccagccatcacccaccat

SEQ ID NO: 36366 - DNA, 20 bp, Artificial Sequence
  Synthetic Construct
ccaaagcccaacctggcaat

SEQ ID NO: 36367 - DNA, 20 bp, Artificial Sequence
  Synthetic Construct
gggcctttgtgagccaaact

SEQ ID NO: 36368 - DNA, 22 bp, Artificial Sequence
  Synthetic Construct
atgccctctccccatccagctt

SEQ ID NO: 36369 - DNA, 25 bp, Artificial Sequence
  Synthetic Construct
gttccgtagatttgagctgtgctaa

SEQ ID NO: 36370 - DNA, 19 bp, Artificial Sequence
  Synthetic Construct
ccaagcactccccgactca

SEQ ID NO: 36371 - DNA, 20 bp, Artificial Sequence
  Synthetic Construct
actgggaggcttgctggaaa

SEQ ID NO: 36372 - DNA, 22 bp, Artificial Sequence
  Synthetic Construct
aagcagctctaatggctgttga

SEQ ID NO: 36373 - DNA, 22 bp, Artificial Sequence
  Synthetic Construct
ggcctgactttctgtggcacta

SEQ ID NO: 36374 - DNA, 23 bp, Artificial Sequence
  Synthetic Construct
aaatgcattccccagagatggaa

SEQ ID NO: 36375 - DNA, 22 bp, Artificial Sequence
  Synthetic Construct
tctttccaaagcacccagttgt

SEQ ID NO: 36376 - DNA, 26 bp, Artificial Sequence
  Synthetic Construct
gggccagaataagcaacaaagccaat

SEQ ID NO: 36377 - DNA, 20 bp, Artificial Sequence
  Synthetic Construct
ggcgtggctgacacaaactt

SEQ ID NO: 36378 - DNA, 19 bp, Artificial Sequence
  Synthetic Construct
tggccaaaacccgccttca

SEQ ID NO: 36379 - DNA, 22 bp, Artificial Sequence
  Synthetic Construct
gcaactcccatccaggtctaca

SEQ ID NO: 36380 - DNA, 25 bp, Artificial Sequence
  Synthetic Construct
gcataaactcgggtatggctgaaag

SEQ ID NO: 36381 - DNA, 22 bp, Artificial Sequence
  Synthetic Construct
accatgaacctgtcctctcctt

SEQ ID NO: 36382 - DNA, 23 bp, Artificial Sequence
  Synthetic Construct
cctggagctaaatgacgcagaaa

SEQ ID NO: 36383 - DNA, 22 bp, Artificial Sequence
  Synthetic Construct
gctcttccctccaccagtctct

SEQ ID NO: 36384 - DNA, 18 bp, Artificial Sequence
  Synthetic Construct
catgtgcggggccacttt

SEQ ID NO: 36385 - DNA, 25 bp, Artificial Sequence
  Synthetic Construct
gtttttacctagggtgaacggtact

SEQ ID NO: 36386 - DNA, 24 bp, Artificial Sequence
  Synthetic Construct
cagtgtcagctgttttgcaaagtt

SEQ ID NO: 36387 - DNA, 27 bp, Artificial Sequence
  Synthetic Construct
ggtacaaaatccctcagtcctaaccat

SEQ ID NO: 36388 - DNA, 23 bp, Artificial Sequence
  Synthetic Construct
cacctagtatgggagtgcagtgt

SEQ ID NO: 36389 - DNA, 21 bp, Artificial Sequence
  Synthetic Construct
gctgggagtcacgctgtttca

SEQ ID NO: 36390 - DNA, 22 bp, Artificial Sequence
  Synthetic Construct
gactgtccaggtccaagtgcat

SEQ ID NO: 36391 - DNA, 19 bp, Artificial Sequence
  Synthetic Construct
actgcctggcttcccttca

SEQ ID NO: 36392 - DNA, 21 bp, Artificial Sequence
  Synthetic Construct
tctggatacaggagccacctt

SEQ ID NO: 36393 - DNA, 22 bp, Artificial Sequence
  Synthetic Construct
cagtcttcatgggccagtcttc

SEQ ID NO: 36394 - DNA, 21 bp, Artificial Sequence
  Synthetic Construct
accacgtgtcaccccagattg

SEQ ID NO: 36395 - DNA, 22 bp, Artificial Sequence
  Synthetic Construct
gatctgttggcctctgttccat

SEQ ID NO: 36396 - DNA, 24 bp, Artificial Sequence
  Synthetic Construct
ctgatgacatgcagcagagacagt

SEQ ID NO: 36397 - DNA, 18 bp, Artificial Sequence
  Synthetic Construct
ttgcctgcaaggccaact

SEQ ID NO: 36398 - DNA, 24 bp, Artificial Sequence
  Synthetic Construct
ccaaggaggaacaaaaaggagaca

SEQ ID NO: 36399 - DNA, 25 bp, Artificial Sequence
  Synthetic Construct
ggaggacagtgtatggtcacgaatc

SEQ ID NO: 36400 - DNA, 20 bp, Artificial Sequence
  Synthetic Construct
gaggcaaggctgttctgtga

SEQ ID NO: 36401 - DNA, 22 bp, Artificial Sequence
  Synthetic Construct
gggtatggagaggcccacattg

SEQ ID NO: 36402 - DNA, 22 bp, Artificial Sequence
  Synthetic Construct
catctcctgcccaactccattg

SEQ ID NO: 36403 - DNA, 24 bp, Artificial Sequence
  Synthetic Construct
catgggttggttttcaccacaatc

SEQ ID NO: 36404 - DNA, 22 bp, Artificial Sequence
  Synthetic Construct
cctgccctggggtttcttttgt

SEQ ID NO: 36405 - DNA, 24 bp, Artificial Sequence
  Synthetic Construct
cattgaacttcagcaccacgtatg

SEQ ID NO: 36406 - DNA, 27 bp, Artificial Sequence
  Synthetic Construct
gggcactgtgttttcattttctgtcaa

SEQ ID NO: 36407 - DNA, 20 bp, Artificial Sequence
  Synthetic Construct
cctgccggatggcagaacat

SEQ ID NO: 36408 - DNA, 23 bp, Artificial Sequence
  Synthetic Construct
gggagatgattaggggaggctta

SEQ ID NO: 36409 - DNA, 20 bp, Artificial Sequence
  Synthetic Construct
agtgctgcatccgctgagaa

SEQ ID NO: 36410 - DNA, 20 bp, Artificial Sequence
  Synthetic Construct
agcggctctcctcctacaga

SEQ ID NO: 36411 - DNA, 20 bp, Artificial Sequence
  Synthetic Construct
tgccatggtgtggtctcaag

SEQ ID NO: 36412 - DNA, 22 bp, Artificial Sequence
  Synthetic Construct
ccgcctgctggtcattgttcta

SEQ ID NO: 36413 - DNA, 20 bp, Artificial Sequence
  Synthetic Construct
gccaatggctgggctgtatt

SEQ ID NO: 36414 - DNA, 19 bp, Artificial Sequence
  Synthetic Construct
tgcctcctccctggggttt

SEQ ID NO: 36415 - DNA, 20 bp, Artificial Sequence
  Synthetic Construct
cacagccaatctgggcatct

SEQ ID NO: 36416 - DNA, 24 bp, Artificial Sequence
  Synthetic Construct
ggcagagacgtataccaccacctt

SEQ ID NO: 36417 - DNA, 23 bp, Artificial Sequence
  Synthetic Construct
gctcaatacggaggtcggaaaga

SEQ ID NO: 36418 - DNA, 21 bp, Artificial Sequence
  Synthetic Construct
ccctgggtggggctaaaaatc

SEQ ID NO: 36419 - DNA, 30 bp, Artificial Sequence
  Synthetic Construct
cacattgaaaaagaaccctctgatctcttg

SEQ ID NO: 36420 - DNA, 27 bp, Artificial Sequence
  Synthetic Construct
gctgagtatacagccatctcgaacaac

SEQ ID NO: 36421 - DNA, 26 bp, Artificial Sequence
  Synthetic Construct
gggaatagcctaatagggtctacgtt

SEQ ID NO: 36422 - DNA, 20 bp, Artificial Sequence
  Synthetic Construct
agcgtggcctctgtgtcact

SEQ ID NO: 36423 - DNA, 24 bp, Artificial Sequence
  Synthetic Construct
gatgagcttggctcttggtaattg

SEQ ID NO: 36424 - DNA, 23 bp, Artificial Sequence
  Synthetic Construct
gctaggtcttgatgccagagtgt

SEQ ID NO: 36425 - DNA, 25 bp, Artificial Sequence
  Synthetic Construct
ggtgaagtagtgaagggcacaggtt

SEQ ID NO: 36426 - DNA, 23 bp, Artificial Sequence
  Synthetic Construct
gcatttctgctttccaggtttct

SEQ ID NO: 36427 - DNA, 22 bp, Artificial Sequence
  Synthetic Construct
ggacgggaaaaggtgtgcctaa

SEQ ID NO: 36428 - DNA, 22 bp, Artificial Sequence
  Synthetic Construct
acccagcttcagtcactacaac

SEQ ID NO: 36429 - DNA, 20 bp, Artificial Sequence
  Synthetic Construct
accccaagagcccactttgt

SEQ ID NO: 36430 - DNA, 23 bp, Artificial Sequence
  Synthetic Construct
gagcgcacattcatgttgcagaa

SEQ ID NO: 36431 - DNA, 21 bp, Artificial Sequence
  Synthetic Construct
agcctgagaccctgacctttc

SEQ ID NO: 36432 - DNA, 23 bp, Artificial Sequence
  Synthetic Construct
ggaagggatcaaggatggcctta

SEQ ID NO: 36433 - DNA, 23 bp, Artificial Sequence
  Synthetic Construct
ggaaaggaaatgtggcactcttg

SEQ ID NO: 36434 - DNA, 26 bp, Artificial Sequence
  Synthetic Construct
cacaatcggtcagatcttatctggaa

SEQ ID NO: 36435 - DNA, 25 bp, Artificial Sequence
  Synthetic Construct
ccatgaacattggagttgccttttg

SEQ ID NO: 36436 - DNA, 21 bp, Artificial Sequence
  Synthetic Construct
agcagggacatccgcatggta

SEQ ID NO: 36437 - DNA, 24 bp, Artificial Sequence
  Synthetic Construct
gctcaatccggactgtgacgagtt

SEQ ID NO: 36438 - DNA, 22 bp, Artificial Sequence
  Synthetic Construct
ggctgaactgctacagggctat

SEQ ID NO: 36439 - DNA, 20 bp, Artificial Sequence
  Synthetic Construct
ggcaaacaggcatgggaaag

SEQ ID NO: 36440 - DNA, 22 bp, Artificial Sequence
  Synthetic Construct
ctcggaaatccacggggaaatg

SEQ ID NO: 36441 - DNA, 22 bp, Artificial Sequence
  Synthetic Construct
gctaaagggtctgggaggtttg

SEQ ID NO: 36442 - DNA, 23 bp, Artificial Sequence
  Synthetic Construct
ggcttcagggccttagacacttg

SEQ ID NO: 36443 - DNA, 30 bp, Artificial Sequence
  Synthetic Construct
cggaactttctcatctgacacgtctttttc

SEQ ID NO: 36444 - DNA, 27 bp, Artificial Sequence
  Synthetic Construct
gcatcttcaggtctcagacagatcact

SEQ ID NO: 36445 - DNA, 24 bp, Artificial Sequence
  Synthetic Construct
tgaagcacatctctcatccctttc

SEQ ID NO: 36446 - DNA, 20 bp, Artificial Sequence
  Synthetic Construct
agaggtttcccgaggcttgt

SEQ ID NO: 36447 - DNA, 22 bp, Artificial Sequence
  Synthetic Construct
accattgcatgcctgacttcaa

SEQ ID NO: 36448 - DNA, 23 bp, Artificial Sequence
  Synthetic Construct
cactgtcagagccgtcatcttgt

SEQ ID NO: 36449 - DNA, 22 bp, Artificial Sequence
  Synthetic Construct
gggcaagcgtggtaagtggaaa

SEQ ID NO: 36450 - DNA, 20 bp, Artificial Sequence
  Synthetic Construct
gccacatctggggagtgaca

SEQ ID NO: 36451 - DNA, 19 bp, Artificial Sequence
  Synthetic Construct
tgagctggggcgctactac

SEQ ID NO: 36452 - DNA, 26 bp, Artificial Sequence
  Synthetic Construct
ctgggtttgtcttactaaagccaatg

SEQ ID NO: 36453 - DNA, 22 bp, Artificial Sequence
  Synthetic Construct
gcacacagtgctgggtctacaa

SEQ ID NO: 36454 - DNA, 26 bp, Artificial Sequence
  Synthetic Construct
cacaatgttacagagggtagagtcat

SEQ ID NO: 36455 - DNA, 20 bp, Artificial Sequence
  Synthetic Construct
tcccaatcgagggcttgtca

SEQ ID NO: 36456 - DNA, 19 bp, Artificial Sequence
  Synthetic Construct
ccccaggggcaatggtgaa

SEQ ID NO: 36457 - DNA, 25 bp, Artificial Sequence
  Synthetic Construct
ctgtgcaaagaggtctcatcctatc

SEQ ID NO: 36458 - DNA, 25 bp, Artificial Sequence
  Synthetic Construct
cccgaaatcatagtcaccccacact

SEQ ID NO: 36459 - DNA, 21 bp, Artificial Sequence
  Synthetic Construct
gccaatgagcagcaaggacaa

SEQ ID NO: 36460 - DNA, 21 bp, Artificial Sequence
  Synthetic Construct
acagagtggggtgggaagtct

SEQ ID NO: 36461 - DNA, 19 bp, Artificial Sequence
  Synthetic Construct
actgcgggtcacgttgaga

SEQ ID NO: 36462 - DNA, 22 bp, Artificial Sequence
  Synthetic Construct
ggcagactattccttccgcaat

SEQ ID NO: 36463 - DNA, 20 bp, Artificial Sequence
  Synthetic Construct
agctccaatcgcccatcttg

SEQ ID NO: 36464 - DNA, 20 bp, Artificial Sequence
  Synthetic Construct
aggggccgtgtcatttttgt

SEQ ID NO: 36465 - DNA, 20 bp, Artificial Sequence
  Synthetic Construct
ggagagtggcagacccatct

SEQ ID NO: 36466 - DNA, 20 bp, Artificial Sequence
  Synthetic Construct
ccggaaatgcttgccgtcat

SEQ ID NO: 36467 - DNA, 21 bp, Artificial Sequence
  Synthetic Construct
cctggaaactggggtctttgt

SEQ ID NO: 36468 - DNA, 20 bp, Artificial Sequence
  Synthetic Construct
tgtggacttgcctgctgtgt

SEQ ID NO: 36469 - DNA, 24 bp, Artificial Sequence
  Synthetic Construct
cctttggtcacttttcaccaggta

SEQ ID NO: 36470 - DNA, 20 bp, Artificial Sequence
  Synthetic Construct
tggtggccaagttccgagat

SEQ ID NO: 36471 - DNA, 23 bp, Artificial Sequence
  Synthetic Construct
gtccacgccaccattatctcttg

SEQ ID NO: 36472 - DNA, 21 bp, Artificial Sequence
  Synthetic Construct
ggggtgggctccagatacaga

SEQ ID NO: 36473 - DNA, 21 bp, Artificial Sequence
  Synthetic Construct
gggtgagaggaatgcagaaca

SEQ ID NO: 36474 - DNA, 26 bp, Artificial Sequence
  Synthetic Construct
cgcaaaacttgatgcttccctcattc

SEQ ID NO: 36475 - DNA, 27 bp, Artificial Sequence
  Synthetic Construct
cgatctctaaggatcttccgtggtcta

SEQ ID NO: 36476 - DNA, 21 bp, Artificial Sequence
  Synthetic Construct
ccgtgacacctggactctttc

SEQ ID NO: 36477 - DNA, 23 bp, Artificial Sequence
  Synthetic Construct
tgctcctcaaacataccaagcat

SEQ ID NO: 36478 - DNA, 20 bp, Artificial Sequence
  Synthetic Construct
agaagccatggtggggaaga

SEQ ID NO: 36479 - DNA, 19 bp, Artificial Sequence
  Synthetic Construct
ggtcagcagcctcgtggaa

SEQ ID NO: 36480 - DNA, 22 bp, Artificial Sequence
  Synthetic Construct
gcgacatgatttgcaggcaatg

SEQ ID NO: 36481 - DNA, 19 bp, Artificial Sequence
  Synthetic Construct
gcggtgcagagcacagaga

SEQ ID NO: 36482 - DNA, 28 bp, Artificial Sequence
  Synthetic Construct
gagctctaaaccaaaccctcaatcaaac

SEQ ID NO: 36483 - DNA, 22 bp, Artificial Sequence
  Synthetic Construct
actcaccggctctcctttctct

SEQ ID NO: 36484 - DNA, 22 bp, Artificial Sequence
  Synthetic Construct
gcctggacagacaacagctact

SEQ ID NO: 36485 - DNA, 20 bp, Artificial Sequence
  Synthetic Construct
atgtctggctgtggctgttg

SEQ ID NO: 36486 - DNA, 21 bp, Artificial Sequence
  Synthetic Construct
ccctgagctaggccttggttt

SEQ ID NO: 36487 - DNA, 21 bp, Artificial Sequence
  Synthetic Construct
gccacagccagaagaaacaca

SEQ ID NO: 36488 - DNA, 22 bp, Artificial Sequence
  Synthetic Construct
ggcaacagacacagcccatcta

SEQ ID NO: 36489 - DNA, 24 bp, Artificial Sequence
  Synthetic Construct
ggaaagaactggaagcaggcaact

SEQ ID NO: 36490 - DNA, 23 bp, Artificial Sequence
  Synthetic Construct
ggataggctggtaccatgagaag

SEQ ID NO: 36491 - DNA, 24 bp, Artificial Sequence
  Synthetic Construct
tggacaagcccttaacacttgatg

SEQ ID NO: 36492 - DNA, 25 bp, Artificial Sequence
  Synthetic Construct
ggctccaaggattaaggtcccagaa

SEQ ID NO: 36493 - DNA, 25 bp, Artificial Sequence
  Synthetic Construct
ggtcaatacttagggagcctgtact

SEQ ID NO: 36494 - DNA, 21 bp, Artificial Sequence
  Synthetic Construct
gtttcctaagtggcgggaaca

SEQ ID NO: 36495 - DNA, 20 bp, Artificial Sequence
  Synthetic Construct
ttgccctttggccctagact

SEQ ID NO: 36496 - DNA, 22 bp, Artificial Sequence
  Synthetic Construct
tgttcccaccaggactccatct

SEQ ID NO: 36497 - DNA, 18 bp, Artificial Sequence
  Synthetic Construct
accagggctgggaagtca

SEQ ID NO: 36498 - DNA, 22 bp, Artificial Sequence
  Synthetic Construct
gagcctagtgatcggggtttct

SEQ ID NO: 36499 - DNA, 22 bp, Artificial Sequence
  Synthetic Construct
gcctgatgtgttgccagtgttg

SEQ ID NO: 36500 - DNA, 22 bp, Artificial Sequence
  Synthetic Construct
ctggggaaactgcatgggaagt

SEQ ID NO: 36501 - DNA, 24 bp, Artificial Sequence
  Synthetic Construct
gacacagactgaaaaccaggaagt

SEQ ID NO: 36502 - DNA, 22 bp, Artificial Sequence
  Synthetic Construct
gtgcgtctcgcaggcaattatc

SEQ ID NO: 36503 - DNA, 24 bp, Artificial Sequence
  Synthetic Construct
ctgtcttcacaccttcacctccta

SEQ ID NO: 36504 - DNA, 19 bp, Artificial Sequence
  Synthetic Construct
gcaggccactctgctctca

SEQ ID NO: 36505 - DNA, 20 bp, Artificial Sequence
  Synthetic Construct
tgggcacctcacccatgtca

SEQ ID NO: 36506 - DNA, 24 bp, Artificial Sequence
  Synthetic Construct
gaagaaaaagggccgttctaccat

SEQ ID NO: 36507 - DNA, 20 bp, Artificial Sequence
  Synthetic Construct
tcactggctgacgactccaa

SEQ ID NO: 36508 - DNA, 22 bp, Artificial Sequence
  Synthetic Construct
cctactggagtttggcctgtct

SEQ ID NO: 36509 - DNA, 19 bp, Artificial Sequence
  Synthetic Construct
cacggagaccccaccatca

SEQ ID NO: 36510 - DNA, 23 bp, Artificial Sequence
  Synthetic Construct
ccctgatgctctgagtggtgttt

SEQ ID NO: 36511 - DNA, 26 bp, Artificial Sequence
  Synthetic Construct
gatagagcacataacctgagcaattc

SEQ ID NO: 36512 - DNA, 21 bp, Artificial Sequence
  Synthetic Construct
cacagaactggagccctgaat

SEQ ID NO: 36513 - DNA, 20 bp, Artificial Sequence
  Synthetic Construct
tcacgctaggtggtggtgaa

SEQ ID NO: 36514 - DNA, 20 bp, Artificial Sequence
  Synthetic Construct
aggacatggaagggcctcaa

SEQ ID NO: 36515 - DNA, 21 bp, Artificial Sequence
  Synthetic Construct
cccatggcccagatgaacagt

SEQ ID NO: 36516 - DNA, 18 bp, Artificial Sequence
  Synthetic Construct
tggcagtcctggcaccat

SEQ ID NO: 36517 - DNA, 20 bp, Artificial Sequence
  Synthetic Construct
gaagccttggcagacacaga

SEQ ID NO: 36518 - DNA, 20 bp, Artificial Sequence
  Synthetic Construct
cagtgtcagggtgggactca

SEQ ID NO: 36519 - DNA, 23 bp, Artificial Sequence
  Synthetic Construct
ggagggaagaacctgcttgctta

SEQ ID NO: 36520 - DNA, 21 bp, Artificial Sequence
  Synthetic Construct
atgtccctgtgccgtgtctct

SEQ ID NO: 36521 - DNA, 21 bp, Artificial Sequence
  Synthetic Construct
cccttggacttcagccagtca

SEQ ID NO: 36522 - DNA, 21 bp, Artificial Sequence
  Synthetic Construct
gcccctgctcctttgcactta

SEQ ID NO: 36523 - DNA, 20 bp, Artificial Sequence
  Synthetic Construct
cctagggtagctgccaccaa

SEQ ID NO: 36524 - DNA, 23 bp, Artificial Sequence
  Synthetic Construct
gcaaatgagtgttgggcgggaaa

SEQ ID NO: 36525 - DNA, 22 bp, Artificial Sequence
  Synthetic Construct
gctcacaccctcttcaccacaa

SEQ ID NO: 36526 - DNA, 20 bp, Artificial Sequence
  Synthetic Construct
acagcccatctgtggtgctt

SEQ ID NO: 36527 - DNA, 20 bp, Artificial Sequence
  Synthetic Construct
ggaggcagaggccagatgta

SEQ ID NO: 36528 - DNA, 20 bp, Artificial Sequence
  Synthetic Construct
tgtcagctgaggggatgagt

SEQ ID NO: 36529 - DNA, 25 bp, Artificial Sequence
  Synthetic Construct
catcgacattgcctaaaacctcttg

SEQ ID NO: 36530 - DNA, 20 bp, Artificial Sequence
  Synthetic Construct
aggctcacgtgccagagagt

SEQ ID NO: 36531 - DNA, 20 bp, Artificial Sequence
  Synthetic Construct
ggcccagggaagaagcaaca

SEQ ID NO: 36532 - DNA, 22 bp, Artificial Sequence
  Synthetic Construct
cagaccagattacgccccaaag

SEQ ID NO: 36533 - DNA, 20 bp, Artificial Sequence
  Synthetic Construct
gggctttttgcgccaggaaa

SEQ ID NO: 36534 - DNA, 19 bp, Artificial Sequence
  Synthetic Construct
ccgacctcagtggggagaa

SEQ ID NO: 36535 - DNA, 20 bp, Artificial Sequence
  Synthetic Construct
tcgctgccacagagggtgaa

SEQ ID NO: 36536 - DNA, 22 bp, Artificial Sequence
  Synthetic Construct
cacctctgatgccagctgttct

SEQ ID NO: 36537 - DNA, 20 bp, Artificial Sequence
  Synthetic Construct
cgcttaggcacagggattga

SEQ ID NO: 36538 - DNA, 22 bp, Artificial Sequence
  Synthetic Construct
gaggcaagagacaagtcagtca

SEQ ID NO: 36539 - DNA, 22 bp, Artificial Sequence
  Synthetic Construct
gaacacatgagccacagacagt

SEQ ID NO: 36540 - DNA, 19 bp, Artificial Sequence
  Synthetic Construct
acgcccaggaggagacaac

SEQ ID NO: 36541 - DNA, 21 bp, Artificial Sequence
  Synthetic Construct
aggagagctgaggaccagaca

SEQ ID NO: 36542 - DNA, 19 bp, Artificial Sequence
  Synthetic Construct
atctcctggtggcgctgaa

SEQ ID NO: 36543 - DNA, 20 bp, Artificial Sequence
  Synthetic Construct
tccccagccagccaggtgat

SEQ ID NO: 36544 - DNA, 20 bp, Artificial Sequence
  Synthetic Construct
cccatgccaacaggacatct

SEQ ID NO: 36545 - DNA, 21 bp, Artificial Sequence
  Synthetic Construct
ggaccgactcttgcctcatct

SEQ ID NO: 36546 - DNA, 19 bp, Artificial Sequence
  Synthetic Construct
tggaccccgcaagtactca

SEQ ID NO: 36547 - DNA, 20 bp, Artificial Sequence
  Synthetic Construct
cccctgaccacacacactga

SEQ ID NO: 36548 - DNA, 22 bp, Artificial Sequence
  Synthetic Construct
ggcctgccctttgatctagttg

SEQ ID NO: 36549 - DNA, 22 bp, Artificial Sequence
  Synthetic Construct
cgtgcagtgaaacctggagtga

SEQ ID NO: 36550 - DNA, 22 bp, Artificial Sequence
  Synthetic Construct
aggaggcttcgggatggacaat

SEQ ID NO: 36551 - DNA, 22 bp, Artificial Sequence
  Synthetic Construct
gcataacctcagtgccctcaca

SEQ ID NO: 36552 - DNA, 25 bp, Artificial Sequence
  Synthetic Construct
tggggctttatttgggaagtgtaaa

SEQ ID NO: 36553 - DNA, 22 bp, Artificial Sequence
  Synthetic Construct
ctcttcccaggtcccttctttc

SEQ ID NO: 36554 - DNA, 22 bp, Artificial Sequence
  Synthetic Construct
gcttttgctctggccatgtaag

SEQ ID NO: 36555 - DNA, 19 bp, Artificial Sequence
  Synthetic Construct
tttgggaacccggggcata

SEQ ID NO: 36556 - DNA, 22 bp, Artificial Sequence
  Synthetic Construct
ggccagctaattccagcagact

SEQ ID NO: 36557 - DNA, 20 bp, Artificial Sequence
  Synthetic Construct
agacagagcaaggggctgat

SEQ ID NO: 36558 - DNA, 22 bp, Artificial Sequence
  Synthetic Construct
gctccacaaatggctcccagaa

SEQ ID NO: 36559 - DNA, 20 bp, Artificial Sequence
  Synthetic Construct
cgctgtctgtcacgctttgt

SEQ ID NO: 36560 - DNA, 18 bp, Artificial Sequence
  Synthetic Construct
agggagtcagcggacgtt

SEQ ID NO: 36561 - DNA, 24 bp, Artificial Sequence
  Synthetic Construct
gtgggtctgtgtggagatggatac

SEQ ID NO: 36562 - DNA, 18 bp, Artificial Sequence
  Synthetic Construct
ttgggagcagggctggaa

SEQ ID NO: 36563 - DNA, 20 bp, Artificial Sequence
  Synthetic Construct
cccctccaaggggtgattgt

SEQ ID NO: 36564 - DNA, 20 bp, Artificial Sequence
  Synthetic Construct
gccacagcgtccagcttcat

SEQ ID NO: 36565 - DNA, 19 bp, Artificial Sequence
  Synthetic Construct
acacgactccaggccacat

SEQ ID NO: 36566 - DNA, 21 bp, Artificial Sequence
  Synthetic Construct
tgagcacgtcagcgtctctac

SEQ ID NO: 36567 - DNA, 23 bp, Artificial Sequence
  Synthetic Construct
cccaaggtggggaagaaggtttg

SEQ ID NO: 36568 - DNA, 27 bp, Artificial Sequence
  Synthetic Construct
gggtataaaactcccagagcccatttc

SEQ ID NO: 36569 - DNA, 25 bp, Artificial Sequence
  Synthetic Construct
ggagggaagactcctcactttgtct

SEQ ID NO: 36570 - DNA, 21 bp, Artificial Sequence
  Synthetic Construct
ttgaagcggggaggcctggtt

SEQ ID NO: 36571 - DNA, 22 bp, Artificial Sequence
  Synthetic Construct
ggtgattacatccccgccacta

SEQ ID NO: 36572 - DNA, 24 bp, Artificial Sequence
  Synthetic Construct
ctgccccaatcttcatttcctttc

SEQ ID NO: 36573 - DNA, 23 bp, Artificial Sequence
  Synthetic Construct
ccagggtcttgtttccactgaca

SEQ ID NO: 36574 - DNA, 18 bp, Artificial Sequence
  Synthetic Construct
atttggcgtgccgtgcat

SEQ ID NO: 36575 - DNA, 20 bp, Artificial Sequence
  Synthetic Construct
tgcccattggcttcccctaa

SEQ ID NO: 36576 - DNA, 20 bp, Artificial Sequence
  Synthetic Construct
tgaggaaggccccaaggaaa

SEQ ID NO: 36577 - DNA, 20 bp, Artificial Sequence
  Synthetic Construct
tgggcttcgtggcatcttca

SEQ ID NO: 36578 - DNA, 24 bp, Artificial Sequence
  Synthetic Construct
gttgactttgatcaccagccattc

SEQ ID NO: 36579 - DNA, 20 bp, Artificial Sequence
  Synthetic Construct
atgcccttgcgtagggtttg

SEQ ID NO: 36580 - DNA, 21 bp, Artificial Sequence
  Synthetic Construct
ttagcaggagccccacactca

SEQ ID NO: 36581 - DNA, 22 bp, Artificial Sequence
  Synthetic Construct
ccacctattgcagggagctgtt

SEQ ID NO: 36582 - DNA, 22 bp, Artificial Sequence
  Synthetic Construct
gctgtgtaccatggtggaaact

SEQ ID NO: 36583 - DNA, 25 bp, Artificial Sequence
  Synthetic Construct
gctgcagatgaatgtctctggatct

SEQ ID NO: 36584 - DNA, 21 bp, Artificial Sequence
  Synthetic Construct
gccagcgtacacatccctgaa

SEQ ID NO: 36585 - DNA, 22 bp, Artificial Sequence
  Synthetic Construct
cccatctcttccctgagacaac

SEQ ID NO: 36586 - DNA, 28 bp, Artificial Sequence
  Synthetic Construct
cagaggacattaagaaaactccctctga

SEQ ID NO: 36587 - DNA, 24 bp, Artificial Sequence
  Synthetic Construct
gtaactaatcacagggcagctcaa

SEQ ID NO: 36588 - DNA, 22 bp, Artificial Sequence
  Synthetic Construct
ctgcctgccttctctgcttttc

SEQ ID NO: 36589 - DNA, 22 bp, Artificial Sequence
  Synthetic Construct
cttgtcagaactgctcccatgt

SEQ ID NO: 36590 - DNA, 22 bp, Artificial Sequence
  Synthetic Construct
gggcctgaggaactgttaccat

SEQ ID NO: 36591 - DNA, 20 bp, Artificial Sequence
  Synthetic Construct
atgtgtccttgggcctgtga

SEQ ID NO: 36592 - DNA, 21 bp, Artificial Sequence
  Synthetic Construct
tgtgccagactctgtgtgaga

SEQ ID NO: 36593 - DNA, 23 bp, Artificial Sequence
  Synthetic Construct
gaggctttgtcatggtgagtcaa

SEQ ID NO: 36594 - DNA, 21 bp, Artificial Sequence
  Synthetic Construct
tgcctgccataggggagcata

SEQ ID NO: 36595 - DNA, 23 bp, Artificial Sequence
  Synthetic Construct
ccaaacacaccaggttgtctcta

SEQ ID NO: 36596 - DNA, 20 bp, Artificial Sequence
  Synthetic Construct
agcttctcagcctggtggta

SEQ ID NO: 36597 - DNA, 22 bp, Artificial Sequence
  Synthetic Construct
gaaggctggagaatgtggtaca

SEQ ID NO: 36598 - DNA, 21 bp, Artificial Sequence
  Synthetic Construct
tggggtcttctgcagccacta

SEQ ID NO: 36599 - DNA, 22 bp, Artificial Sequence
  Synthetic Construct
actgcctcactcctcatgtact

SEQ ID NO: 36600 - DNA, 20 bp, Artificial Sequence
  Synthetic Construct
agggcagccccaacctcatt

SEQ ID NO: 36601 - DNA, 23 bp, Artificial Sequence
  Synthetic Construct
ccaaaaacccacaggcaggttag

SEQ ID NO: 36602 - DNA, 20 bp, Artificial Sequence
  Synthetic Construct
agggtggggacgtgtagtca

SEQ ID NO: 36603 - DNA, 23 bp, Artificial Sequence
  Synthetic Construct
gcgaaacgtggtgatcctcaaag

SEQ ID NO: 36604 - DNA, 23 bp, Artificial Sequence
  Synthetic Construct
gggctccaaaacgtatcctggtt

SEQ ID NO: 36605 - DNA, 22 bp, Artificial Sequence
  Synthetic Construct
ggaggtggggcagaatggaatc

SEQ ID NO: 36606 - DNA, 21 bp, Artificial Sequence
  Synthetic Construct
ccaagctgtctcgggacctat

SEQ ID NO: 36607 - DNA, 23 bp, Artificial Sequence
  Synthetic Construct
ccagttcctatgcctggactttt

SEQ ID NO: 36608 - DNA, 20 bp, Artificial Sequence
  Synthetic Construct
caaggccctgttccctctct

SEQ ID NO: 36609 - DNA, 23 bp, Artificial Sequence
  Synthetic Construct
ggggactgcagagatatgagctt

SEQ ID NO: 36610 - DNA, 24 bp, Artificial Sequence
  Synthetic Construct
agtgaagttggaaaccaaggttga

SEQ ID NO: 36611 - DNA, 20 bp, Artificial Sequence
  Synthetic Construct
tgggccagagcaaggctgat

SEQ ID NO: 36612 - DNA, 20 bp, Artificial Sequence
  Synthetic Construct
tagaggccgcaatgctgaca

SEQ ID NO: 36613 - DNA, 21 bp, Artificial Sequence
  Synthetic Construct
gtgctgaaggccaagaggaaa

SEQ ID NO: 36614 - DNA, 19 bp, Artificial Sequence
  Synthetic Construct
ccagcagccctcgcaagat

SEQ ID NO: 36615 - DNA, 22 bp, Artificial Sequence
  Synthetic Construct
tcaaggtgacctctggaaccaa

SEQ ID NO: 36616 - DNA, 19 bp, Artificial Sequence
  Synthetic Construct
agccagggctgtccacgaa

SEQ ID NO: 36617 - DNA, 25 bp, Artificial Sequence
  Synthetic Construct
gggcacaagcaatacttaggcagaa

SEQ ID NO: 36618 - DNA, 19 bp, Artificial Sequence
  Synthetic Construct
ttgcggagaggggccttca

SEQ ID NO: 36619 - DNA, 24 bp, Artificial Sequence
  Synthetic Construct
gctgggagggctgagtatgatgta

SEQ ID NO: 36620 - DNA, 25 bp, Artificial Sequence
  Synthetic Construct
ggggtggatgggaatattgggaaac

SEQ ID NO: 36621 - DNA, 25 bp, Artificial Sequence
  Synthetic Construct
ggtggagtggtagatgttcttgctt

SEQ ID NO: 36622 - DNA, 22 bp, Artificial Sequence
  Synthetic Construct
gctgtgctcagccagatgtgat

SEQ ID NO: 36623 - DNA, 23 bp, Artificial Sequence
  Synthetic Construct
ggactccctcaagcaggaagttg

SEQ ID NO: 36624 - DNA, 26 bp, Artificial Sequence
  Synthetic Construct
gcacaagtgctgttctcaaaatcaca

SEQ ID NO: 36625 - DNA, 22 bp, Artificial Sequence
  Synthetic Construct
gctctgcttcttgccacctact

SEQ ID NO: 36626 - DNA, 22 bp, Artificial Sequence
  Synthetic Construct
gagcgcaatgtctccctgtatg

SEQ ID NO: 36627 - DNA, 21 bp, Artificial Sequence
  Synthetic Construct
ctgggatttccaacccaccaa

SEQ ID NO: 36628 - DNA, 22 bp, Artificial Sequence
  Synthetic Construct
ctggtggccaatggggataact

SEQ ID NO: 36629 - DNA, 25 bp, Artificial Sequence
  Synthetic Construct
gtccctcacttttctaagcctctgt

SEQ ID NO: 36630 - DNA, 20 bp, Artificial Sequence
  Synthetic Construct
gcgtggcgtgttagaaggta

SEQ ID NO: 36631 - DNA, 21 bp, Artificial Sequence
  Synthetic Construct
ttgcctggagccgggaaagtt

SEQ ID NO: 36632 - DNA, 26 bp, Artificial Sequence
  Synthetic Construct
gcttcctctctttcatgtgatgttct

SEQ ID NO: 36633 - DNA, 25 bp, Artificial Sequence
  Synthetic Construct
gagttttgtgtgatagaggcgtaga

SEQ ID NO: 36634 - DNA, 24 bp, Artificial Sequence
  Synthetic Construct
ggctagtgccaggctcatatctca

SEQ ID NO: 36635 - DNA, 25 bp, Artificial Sequence
  Synthetic Construct
gatgttacaagtggatggcttccta

SEQ ID NO: 36636 - DNA, 20 bp, Artificial Sequence
  Synthetic Construct
tagctgctggctgtgagttc

SEQ ID NO: 36637 - DNA, 24 bp, Artificial Sequence
  Synthetic Construct
ggtctaggtagtgtgaggttcagt

SEQ ID NO: 36638 - DNA, 24 bp, Artificial Sequence
  Synthetic Construct
tcacgttctttccttccagattgt

SEQ ID NO: 36639 - DNA, 22 bp, Artificial Sequence
  Synthetic Construct
ctgaaaggggcacatcccatca

SEQ ID NO: 36640 - DNA, 20 bp, Artificial Sequence
  Synthetic Construct
gcacaaacaccccacaggat

SEQ ID NO: 36641 - DNA, 19 bp, Artificial Sequence
  Synthetic Construct
aggcattccgaggctcaca

SEQ ID NO: 36642 - DNA, 25 bp, Artificial Sequence
  Synthetic Construct
gcccaatggctgggatattaaaaag

SEQ ID NO: 36643 - DNA, 19 bp, Artificial Sequence
  Synthetic Construct
cgggagcagcaagtgcaaa

SEQ ID NO: 36644 - DNA, 20 bp, Artificial Sequence
  Synthetic Construct
tgtccagctcagccacttgt

SEQ ID NO: 36645 - DNA, 22 bp, Artificial Sequence
  Synthetic Construct
gcaggtgtcctacccaatgact

SEQ ID NO: 36646 - DNA, 22 bp, Artificial Sequence
  Synthetic Construct
tctggaaggatcagaggctcaa

SEQ ID NO: 36647 - DNA, 19 bp, Artificial Sequence
  Synthetic Construct
gcttgcggcagcagaacaa

SEQ ID NO: 36648 - DNA, 20 bp, Artificial Sequence
  Synthetic Construct
ttgaggcctgttgggtgctt

SEQ ID NO: 36649 - DNA, 21 bp, Artificial Sequence
  Synthetic Construct
gaagttgcaaaagccgtcact

SEQ ID NO: 36650 - DNA, 19 bp, Artificial Sequence
  Synthetic Construct
taggtgcccgccaccacat

SEQ ID NO: 36651 - DNA, 21 bp, Artificial Sequence
  Synthetic Construct
aggcactgagacagagtgagt

SEQ ID NO: 36652 - DNA, 19 bp, Artificial Sequence
  Synthetic Construct
tgttaaccccgtgcagcaa

SEQ ID NO: 36653 - DNA, 20 bp, Artificial Sequence
  Synthetic Construct
ctgcagaggttcggcatgaa

SEQ ID NO: 36654 - DNA, 24 bp, Artificial Sequence
  Synthetic Construct
ccggggtcacatgtgcttaagtgt

SEQ ID NO: 36655 - DNA, 19 bp, Artificial Sequence
  Synthetic Construct
acgcgcccaggtgatgttg

SEQ ID NO: 36656 - DNA, 19 bp, Artificial Sequence
  Synthetic Construct
ctgcatctggcccctccta

SEQ ID NO: 36657 - DNA, 25 bp, Artificial Sequence
  Synthetic Construct
gcctggatggacttcaaacttgctt

SEQ ID NO: 36658 - DNA, 24 bp, Artificial Sequence
  Synthetic Construct
gggaaaatgagccctgtgaacttg

SEQ ID NO: 36659 - DNA, 22 bp, Artificial Sequence
  Synthetic Construct
cagactggctttgtctgggaaa

SEQ ID NO: 36660 - DNA, 22 bp, Artificial Sequence
  Synthetic Construct
cttgggagttggagccactttc

SEQ ID NO: 36661 - DNA, 25 bp, Artificial Sequence
  Synthetic Construct
ggaggatttccacttgcttttgcat

SEQ ID NO: 36662 - DNA, 24 bp, Artificial Sequence
  Synthetic Construct
ggcatagaaggattccaagactca

SEQ ID NO: 36663 - DNA, 20 bp, Artificial Sequence
  Synthetic Construct
tgacgcatgcctgggaaaag

SEQ ID NO: 36664 - DNA, 21 bp, Artificial Sequence
  Synthetic Construct
agggctgttcttgacacacaa

SEQ ID NO: 36665 - DNA, 22 bp, Artificial Sequence
  Synthetic Construct
ctgcttcctcccacaagacaga

SEQ ID NO: 36666 - DNA, 21 bp, Artificial Sequence
  Synthetic Construct
agccatccaggctccccaaat

SEQ ID NO: 36667 - DNA, 22 bp, Artificial Sequence
  Synthetic Construct
cctccatgggctgtttcacatc

SEQ ID NO: 36668 - DNA, 18 bp, Artificial Sequence
  Synthetic Construct
tgcaggggaaggggcaat

SEQ ID NO: 36669 - DNA, 28 bp, Artificial Sequence
  Synthetic Construct
ccacctttgcatagttcagtaggggtta

SEQ ID NO: 36670 - DNA, 23 bp, Artificial Sequence
  Synthetic Construct
cccatccttagcctcatcgatac

SEQ ID NO: 36671 - DNA, 23 bp, Artificial Sequence
  Synthetic Construct
ggaatgccatttgggaggtgtct

SEQ ID NO: 36672 - DNA, 20 bp, Artificial Sequence
  Synthetic Construct
gttcctgagtcgcaccttga

SEQ ID NO: 36673 - DNA, 21 bp, Artificial Sequence
  Synthetic Construct
gagggttgggagaaacagctt

SEQ ID NO: 36674 - DNA, 19 bp, Artificial Sequence
  Synthetic Construct
ggaagatccgcccctctga

SEQ ID NO: 36675 - DNA, 25 bp, Artificial Sequence
  Synthetic Construct
acagagtggatgaagactcacattg

SEQ ID NO: 36676 - DNA, 22 bp, Artificial Sequence
  Synthetic Construct
agaacagaagggcccctgaaag

SEQ ID NO: 36677 - DNA, 19 bp, Artificial Sequence
  Synthetic Construct
agcaccgctcccacctttc

SEQ ID NO: 36678 - DNA, 27 bp, Artificial Sequence
  Synthetic Construct
gcttcactccccaggagaaatgaaatg

SEQ ID NO: 36679 - DNA, 26 bp, Artificial Sequence
  Synthetic Construct
gcaggaatcttgacgaagcctgatct

SEQ ID NO: 36680 - DNA, 25 bp, Artificial Sequence
  Synthetic Construct
gtcccttcacaaacccagtgtttta

SEQ ID NO: 36681 - DNA, 21 bp, Artificial Sequence
  Synthetic Construct
tccctacccacccctccattc

SEQ ID NO: 36682 - DNA, 22 bp, Artificial Sequence
  Synthetic Construct
accccagcttgtatcccctatc

SEQ ID NO: 36683 - DNA, 22 bp, Artificial Sequence
  Synthetic Construct
gaatggggatgtggtgggaatc

SEQ ID NO: 36684 - DNA, 20 bp, Artificial Sequence
  Synthetic Construct
tgccagtttagacgcagtgt

SEQ ID NO: 36685 - DNA, 24 bp, Artificial Sequence
  Synthetic Construct
agcaaagctttaagagcacacatc

SEQ ID NO: 36686 - DNA, 20 bp, Artificial Sequence
  Synthetic Construct
ggcaggtgagaacgttcagt

SEQ ID NO: 36687 - DNA, 20 bp, Artificial Sequence
  Synthetic Construct
gtgtcctgccctgaggtttg

SEQ ID NO: 36688 - DNA, 20 bp, Artificial Sequence
  Synthetic Construct
tcagatccggctgactcaca

SEQ ID NO: 36689 - DNA, 20 bp, Artificial Sequence
  Synthetic Construct
gcccctcatccccaccttca

SEQ ID NO: 36690 - DNA, 21 bp, Artificial Sequence
  Synthetic Construct
ctgaaaccctgcaacgagact

SEQ ID NO: 36691 - DNA, 22 bp, Artificial Sequence
  Synthetic Construct
cacttatcagctgggcctcaca

SEQ ID NO: 36692 - DNA, 23 bp, Artificial Sequence
  Synthetic Construct
ctcagcttaaagccccagctaag

SEQ ID NO: 36693 - DNA, 21 bp, Artificial Sequence
  Synthetic Construct
gctgctagttggctcctgaaa

SEQ ID NO: 36694 - DNA, 21 bp, Artificial Sequence
  Synthetic Construct
ccgcagggaacaatgaaggtt

SEQ ID NO: 36695 - DNA, 21 bp, Artificial Sequence
  Synthetic Construct
tgtgggtggagtcttcgtttg

SEQ ID NO: 36696 - DNA, 24 bp, Artificial Sequence
  Synthetic Construct
agactggagtaacacagccataag

SEQ ID NO: 36697 - DNA, 22 bp, Artificial Sequence
  Synthetic Construct
agtcagaggctccctccctttt

SEQ ID NO: 36698 - DNA, 21 bp, Artificial Sequence
  Synthetic Construct
agacacagtgcacaccacttc

SEQ ID NO: 36699 - DNA, 22 bp, Artificial Sequence
  Synthetic Construct
gcttagagacgctgagcaactt

SEQ ID NO: 36700 - DNA, 21 bp, Artificial Sequence
  Synthetic Construct
agccgtgcagctaggagtagt

SEQ ID NO: 36701 - DNA, 21 bp, Artificial Sequence
  Synthetic Construct
tcgcctttgccaacccctcta

SEQ ID NO: 36702 - DNA, 20 bp, Artificial Sequence
  Synthetic Construct
gtgcctgcatctgaggtcaa

SEQ ID NO: 36703 - DNA, 20 bp, Artificial Sequence
  Synthetic Construct
ctgtggcagctgcaggtttt

SEQ ID NO: 36704 - DNA, 20 bp, Artificial Sequence
  Synthetic Construct
ctggctgggtttggtgacaa

SEQ ID NO: 36705 - DNA, 21 bp, Artificial Sequence
  Synthetic Construct
gccggccctgactttgatctt

SEQ ID NO: 36706 - DNA, 24 bp, Artificial Sequence
  Synthetic Construct
ccacctcctatggcgatggagtaa

SEQ ID NO: 36707 - DNA, 22 bp, Artificial Sequence
  Synthetic Construct
ctcctagttggaccctgggtaa

SEQ ID NO: 36708 - DNA, 22 bp, Artificial Sequence
  Synthetic Construct
ggacatgttgcagcccatctca

SEQ ID NO: 36709 - DNA, 23 bp, Artificial Sequence
  Synthetic Construct
ggtgctgtgcatgaagacagtga

SEQ ID NO: 36710 - DNA, 20 bp, Artificial Sequence
  Synthetic Construct
tccagccatcaggcactttc

SEQ ID NO: 36711 - DNA, 22 bp, Artificial Sequence
  Synthetic Construct
gctcccttggagtctgcatctt

SEQ ID NO: 36712 - DNA, 20 bp, Artificial Sequence
  Synthetic Construct
tggcataagcctggcacaca

SEQ ID NO: 36713 - DNA, 20 bp, Artificial Sequence
  Synthetic Construct
gcttgcagctttgcctgtca

SEQ ID NO: 36714 - DNA, 21 bp, Artificial Sequence
  Synthetic Construct
ggtggtgttggcttgctcttc

SEQ ID NO: 36715 - DNA, 21 bp, Artificial Sequence
  Synthetic Construct
tggagccctgactgctgatct

SEQ ID NO: 36716 - DNA, 19 bp, Artificial Sequence
  Synthetic Construct
tgagcagggcctagcagtt

SEQ ID NO: 36717 - DNA, 19 bp, Artificial Sequence
  Synthetic Construct
gatgtgccagccacacctt

SEQ ID NO: 36718 - DNA, 21 bp, Artificial Sequence
  Synthetic Construct
cccaggttggctccacattct

SEQ ID NO: 36719 - DNA, 22 bp, Artificial Sequence
  Synthetic Construct
gctgtcaacttcctcccttgaa

SEQ ID NO: 36720 - DNA, 26 bp, Artificial Sequence
  Synthetic Construct
tgggatgatggattcatgggttattg

SEQ ID NO: 36721 - DNA, 20 bp, Artificial Sequence
  Synthetic Construct
atctccgccctgcgacagtt

SEQ ID NO: 36722 - DNA, 19 bp, Artificial Sequence
  Synthetic Construct
agccctttcctggctcaca

SEQ ID NO: 36723 - DNA, 23 bp, Artificial Sequence
  Synthetic Construct
gtgccatgagcagacttggtttc

SEQ ID NO: 36724 - DNA, 23 bp, Artificial Sequence
  Synthetic Construct
tgtcctcagagacaatcccttga

SEQ ID NO: 36725 - DNA, 21 bp, Artificial Sequence
  Synthetic Construct
ataggcacaggtccgcagaga

SEQ ID NO: 36726 - DNA, 27 bp, Artificial Sequence
  Synthetic Construct
gtcacttcccatggacttacatttttg

SEQ ID NO: 36727 - DNA, 21 bp, Artificial Sequence
  Synthetic Construct
cccttgtgtgctcctcagtgt

SEQ ID NO: 36728 - DNA, 21 bp, Artificial Sequence
  Synthetic Construct
tctgggtggagagtggagatg

SEQ ID NO: 36729 - DNA, 20 bp, Artificial Sequence
  Synthetic Construct
tgaggcatgtggtcccaaga

SEQ ID NO: 36730 - DNA, 21 bp, Artificial Sequence
  Synthetic Construct
acccactgctgagcctgtttc

SEQ ID NO: 36731 - DNA, 24 bp, Artificial Sequence
  Synthetic Construct
gccttttcagttttgtgccatttc

SEQ ID NO: 36732 - DNA, 20 bp, Artificial Sequence
  Synthetic Construct
atcggtggccgcttgagttt

SEQ ID NO: 36733 - DNA, 20 bp, Artificial Sequence
  Synthetic Construct
agggtccatctgcaggagtt

SEQ ID NO: 36734 - DNA, 19 bp, Artificial Sequence
  Synthetic Construct
atgccccttccgactgttg

SEQ ID NO: 36735 - DNA, 21 bp, Artificial Sequence
  Synthetic Construct
caatggcacatgctggctgta

SEQ ID NO: 36736 - DNA, 20 bp, Artificial Sequence
  Synthetic Construct
ttcttcccagctccggaaac

SEQ ID NO: 36737 - DNA, 22 bp, Artificial Sequence
  Synthetic Construct
ggaacactgttgacctctggtt

SEQ ID NO: 36738 - DNA, 22 bp, Artificial Sequence
  Synthetic Construct
gcctggatggcaaccaacactt

SEQ ID NO: 36739 - DNA, 19 bp, Artificial Sequence
  Synthetic Construct
agccaacccaagcgtcttt

SEQ ID NO: 36740 - DNA, 20 bp, Artificial Sequence
  Synthetic Construct
tgggtctcaggctggcatca

SEQ ID NO: 36741 - DNA, 19 bp, Artificial Sequence
  Synthetic Construct
agagcgagcccaggctttg

SEQ ID NO: 36742 - DNA, 23 bp, Artificial Sequence
  Synthetic Construct
gcaccactgtgtgacagaagcta

SEQ ID NO: 36743 - DNA, 21 bp, Artificial Sequence
  Synthetic Construct
aagctcctagccacccagaca

SEQ ID NO: 36744 - DNA, 20 bp, Artificial Sequence
  Synthetic Construct
tcctcccaggcccaagcaat

SEQ ID NO: 36745 - DNA, 24 bp, Artificial Sequence
  Synthetic Construct
cgatcagtgagggagaagggaaca

SEQ ID NO: 36746 - DNA, 22 bp, Artificial Sequence
  Synthetic Construct
gctcttggccttccgcttcaat

SEQ ID NO: 36747 - DNA, 19 bp, Artificial Sequence
  Synthetic Construct
tgtacgctcccctcacagt

SEQ ID NO: 36748 - DNA, 20 bp, Artificial Sequence
  Synthetic Construct
aggcgtcacagtcagtggat

SEQ ID NO: 36749 - DNA, 21 bp, Artificial Sequence
  Synthetic Construct
ctgccaggcaagcttttcaga

SEQ ID NO: 36750 - DNA, 19 bp, Artificial Sequence
  Synthetic Construct
ggcagcagctggggaagtt

SEQ ID NO: 36751 - DNA, 26 bp, Artificial Sequence
  Synthetic Construct
cacccggctacagttactaatgctat

SEQ ID NO: 36752 - DNA, 21 bp, Artificial Sequence
  Synthetic Construct
cctaggaagtgctgcttcgat

SEQ ID NO: 36753 - DNA, 19 bp, Artificial Sequence
  Synthetic Construct
tcgtgccctcggtctcttg

SEQ ID NO: 36754 - DNA, 22 bp, Artificial Sequence
  Synthetic Construct
cccctccttacctgcaaaggtt

SEQ ID NO: 36755 - DNA, 25 bp, Artificial Sequence
  Synthetic Construct
ggcacgtttggatttcaggttcgat

SEQ ID NO: 36756 - DNA, 19 bp, Artificial Sequence
  Synthetic Construct
ccttcggggctgggcttta

SEQ ID NO: 36757 - DNA, 19 bp, Artificial Sequence
  Synthetic Construct
cccctcctcccgatgttca

SEQ ID NO: 36758 - DNA, 20 bp, Artificial Sequence
  Synthetic Construct
agcaccgagaggcaggtttg

SEQ ID NO: 36759 - DNA, 22 bp, Artificial Sequence
  Synthetic Construct
actggtgtgagcaacttgtgat

SEQ ID NO: 36760 - DNA, 20 bp, Artificial Sequence
  Synthetic Construct
ggccatgctgggagtgtttg

SEQ ID NO: 36761 - DNA, 20 bp, Artificial Sequence
  Synthetic Construct
tgtgcagaggtgctgtggaa

SEQ ID NO: 36762 - DNA, 20 bp, Artificial Sequence
  Synthetic Construct
aaggccaccctggggtgtag

SEQ ID NO: 36763 - DNA, 24 bp, Artificial Sequence
  Synthetic Construct
ccgtagacgtccgaggtaatcatc

SEQ ID NO: 36764 - DNA, 19 bp, Artificial Sequence
  Synthetic Construct
caccgtctcgctggcattt

SEQ ID NO: 36765 - DNA, 22 bp, Artificial Sequence
  Synthetic Construct
tgtcagctgtaatgtgctgtga

SEQ ID NO: 36766 - DNA, 25 bp, Artificial Sequence
  Synthetic Construct
ctgggcatatgctttgaacagattg

SEQ ID NO: 36767 - DNA, 23 bp, Artificial Sequence
  Synthetic Construct
ggctgactttctgagcccctaag

SEQ ID NO: 36768 - DNA, 25 bp, Artificial Sequence
  Synthetic Construct
cacaagagaagagcccatgcaaatc

SEQ ID NO: 36769 - DNA, 22 bp, Artificial Sequence
  Synthetic Construct
ggggagaggaaagccatcttca

SEQ ID NO: 36770 - DNA, 20 bp, Artificial Sequence
  Synthetic Construct
caccagagtggagccaactt

SEQ ID NO: 36771 - DNA, 24 bp, Artificial Sequence
  Synthetic Construct
gcctgtggctaggcttaaataact

SEQ ID NO: 36772 - DNA, 18 bp, Artificial Sequence
  Synthetic Construct
ctgccggaaccgcttctt

SEQ ID NO: 36773 - DNA, 23 bp, Artificial Sequence
  Synthetic Construct
ctgctgtgacaggttctcaccaa

SEQ ID NO: 36774 - DNA, 25 bp, Artificial Sequence
  Synthetic Construct
gggcttgtcttcagttcctcacact

SEQ ID NO: 36775 - DNA, 21 bp, Artificial Sequence
  Synthetic Construct
cgctcagaacccaggtcttca

SEQ ID NO: 36776 - DNA, 20 bp, Artificial Sequence
  Synthetic Construct
tgagcccaggagagaaccat

SEQ ID NO: 36777 - DNA, 20 bp, Artificial Sequence
  Synthetic Construct
caaaccagcgccaagactca

SEQ ID NO: 36778 - DNA, 20 bp, Artificial Sequence
  Synthetic Construct
ctgcttacggacgtggttgt

SEQ ID NO: 36779 - DNA, 22 bp, Artificial Sequence
  Synthetic Construct
gtctctaccttgtggcctggtt

SEQ ID NO: 36780 - DNA, 19 bp, Artificial Sequence
  Synthetic Construct
accaggagcctgggagtct

SEQ ID NO: 36781 - DNA, 22 bp, Artificial Sequence
  Synthetic Construct
ggaggagctgcacgttactaag

SEQ ID NO: 36782 - DNA, 22 bp, Artificial Sequence
  Synthetic Construct
gctgtgacactgctgctcttct

SEQ ID NO: 36783 - DNA, 19 bp, Artificial Sequence
  Synthetic Construct
gctgggtggctctctggaa

SEQ ID NO: 36784 - DNA, 20 bp, Artificial Sequence
  Synthetic Construct
tcacggcagtcacggaacat

SEQ ID NO: 36785 - DNA, 24 bp, Artificial Sequence
  Synthetic Construct
tctgtttgaacgcactgttgattg

SEQ ID NO: 36786 - DNA, 22 bp, Artificial Sequence
  Synthetic Construct
ggccttggctttcaaggtgttg

SEQ ID NO: 36787 - DNA, 23 bp, Artificial Sequence
  Synthetic Construct
gcctaggtgtagattgggcatga

SEQ ID NO: 36788 - DNA, 18 bp, Artificial Sequence
  Synthetic Construct
aacgccgtggccagaaca

SEQ ID NO: 36789 - DNA, 19 bp, Artificial Sequence
  Synthetic Construct
tgcacccgccagaggaaac

SEQ ID NO: 36790 - DNA, 20 bp, Artificial Sequence
  Synthetic Construct
tctggggcccctgcctcttt

SEQ ID NO: 36791 - DNA, 20 bp, Artificial Sequence
  Synthetic Construct
gaacaggctggttcccatga

SEQ ID NO: 36792 - DNA, 22 bp, Artificial Sequence
  Synthetic Construct
ccatgttccccttgaccctgaa

SEQ ID NO: 36793 - DNA, 20 bp, Artificial Sequence
  Synthetic Construct
gcacctttccccagcactaa

SEQ ID NO: 36794 - DNA, 20 bp, Artificial Sequence
  Synthetic Construct
tgtgtggccagactccaaag

SEQ ID NO: 36795 - DNA, 20 bp, Artificial Sequence
  Synthetic Construct
ggaaccggagtggtgtttga

SEQ ID NO: 36796 - DNA, 22 bp, Artificial Sequence
  Synthetic Construct
gaggttctcaccgtcactctgt

SEQ ID NO: 36797 - DNA, 20 bp, Artificial Sequence
  Synthetic Construct
tgcatggtgtgacccgaatc

SEQ ID NO: 36798 - DNA, 21 bp, Artificial Sequence
  Synthetic Construct
ttcagcctgggctccgacact

SEQ ID NO: 36799 - DNA, 18 bp, Artificial Sequence
  Synthetic Construct
agactcggcctgcgtgat

SEQ ID NO: 36800 - DNA, 25 bp, Artificial Sequence
  Synthetic Construct
actttgggtcttgctaaagttcagt

SEQ ID NO: 36801 - DNA, 18 bp, Artificial Sequence
  Synthetic Construct
actgcgcctgagcacgta

SEQ ID NO: 36802 - DNA, 23 bp, Artificial Sequence
  Synthetic Construct
gggtgggaatgagcaaagcatgt

SEQ ID NO: 36803 - DNA, 24 bp, Artificial Sequence
  Synthetic Construct
cccctgggctacgagtatatgtga

SEQ ID NO: 36804 - DNA, 19 bp, Artificial Sequence
  Synthetic Construct
tgtggagcagcccagatca

SEQ ID NO: 36805 - DNA, 25 bp, Artificial Sequence
  Synthetic Construct
gggctatgattaggagagcctatct

SEQ ID NO: 36806 - DNA, 19 bp, Artificial Sequence
  Synthetic Construct
tccgcaagcaagtgctgtt

SEQ ID NO: 36807 - DNA, 22 bp, Artificial Sequence
  Synthetic Construct
aggccagggagtggttgaaaga

SEQ ID NO: 36808 - DNA, 19 bp, Artificial Sequence
  Synthetic Construct
gcacctgtgcccagctact

SEQ ID NO: 36809 - DNA, 22 bp, Artificial Sequence
  Synthetic Construct
ctctttcaagccagacgagtca

SEQ ID NO: 36810 - DNA, 24 bp, Artificial Sequence
  Synthetic Construct
gctgatgtgtgcacagtcactatt

SEQ ID NO: 36811 - DNA, 22 bp, Artificial Sequence
  Synthetic Construct
ccacggatcctcacccaaacat

SEQ ID NO: 36812 - DNA, 22 bp, Artificial Sequence
  Synthetic Construct
acaaaaggatgaggcactggtt

SEQ ID NO: 36813 - DNA, 20 bp, Artificial Sequence
  Synthetic Construct
aggtgcagggctcacagtaa

SEQ ID NO: 36814 - DNA, 21 bp, Artificial Sequence
  Synthetic Construct
gcggctctgagggagaataca

SEQ ID NO: 36815 - DNA, 22 bp, Artificial Sequence
  Synthetic Construct
ttgttggaggagggagggaaac

SEQ ID NO: 36816 - DNA, 24 bp, Artificial Sequence
  Synthetic Construct
gcaggttcaggcaaagtggagaga

SEQ ID NO: 36817 - DNA, 22 bp, Artificial Sequence
  Synthetic Construct
gagaagcccactgtctctctga

SEQ ID NO: 36818 - DNA, 27 bp, Artificial Sequence
  Synthetic Construct
gaaggaagacttaaactggttggtaac

SEQ ID NO: 36819 - DNA, 21 bp, Artificial Sequence
  Synthetic Construct
tgtggtctcagcttggtctga

SEQ ID NO: 36820 - DNA, 24 bp, Artificial Sequence
  Synthetic Construct
acatactcttccttccctccaagt

SEQ ID NO: 36821 - DNA, 24 bp, Artificial Sequence
  Synthetic Construct
agatgaagttaggtgttgctggaa

SEQ ID NO: 36822 - DNA, 23 bp, Artificial Sequence
  Synthetic Construct
cccaccaatcaccatagccagta

SEQ ID NO: 36823 - DNA, 25 bp, Artificial Sequence
  Synthetic Construct
ggacatggaactgtgacccagaaac

SEQ ID NO: 36824 - DNA, 21 bp, Artificial Sequence
  Synthetic Construct
ccccacaaagaaccgcataga

SEQ ID NO: 36825 - DNA, 23 bp, Artificial Sequence
  Synthetic Construct
gcaaacacatgttggcatcaact

SEQ ID NO: 36826 - DNA, 19 bp, Artificial Sequence
  Synthetic Construct
ctcaccccgagacccttgt

SEQ ID NO: 36827 - DNA, 24 bp, Artificial Sequence
  Synthetic Construct
gagggaaatcaaggagcaatgtct

SEQ ID NO: 36828 - DNA, 23 bp, Artificial Sequence
  Synthetic Construct
gtggatggcacacagtcatggta

SEQ ID NO: 36829 - DNA, 21 bp, Artificial Sequence
  Synthetic Construct
catggcacacagtgaccaagt

SEQ ID NO: 36830 - DNA, 22 bp, Artificial Sequence
  Synthetic Construct
gcccgggagctatgacacaaat

SEQ ID NO: 36831 - DNA, 27 bp, Artificial Sequence
  Synthetic Construct
ggcaaaacttttcctcaaccctcttag

SEQ ID NO: 36832 - DNA, 22 bp, Artificial Sequence
  Synthetic Construct
acaccaacagggacaggacttg

SEQ ID NO: 36833 - DNA, 22 bp, Artificial Sequence
  Synthetic Construct
atggtcaacgtgatgacagaca

SEQ ID NO: 36834 - DNA, 22 bp, Artificial Sequence
  Synthetic Construct
tgtttgtaacccctccctctct

SEQ ID NO: 36835 - DNA, 24 bp, Artificial Sequence
  Synthetic Construct
cctgtttgaacaaacccaatgcta

SEQ ID NO: 36836 - DNA, 20 bp, Artificial Sequence
  Synthetic Construct
caggccctggggaatacaga

SEQ ID NO: 36837 - DNA, 21 bp, Artificial Sequence
  Synthetic Construct
tgggaatacggtcggcagttc

SEQ ID NO: 36838 - DNA, 22 bp, Artificial Sequence
  Synthetic Construct
cacctatgcttcccctcacaac

SEQ ID NO: 36839 - DNA, 18 bp, Artificial Sequence
  Synthetic Construct
tgtccctgcgccttcctt

SEQ ID NO: 36840 - DNA, 24 bp, Artificial Sequence
  Synthetic Construct
gccacagttgactctgcactcctt

SEQ ID NO: 36841 - DNA, 26 bp, Artificial Sequence
  Synthetic Construct
ccagcccattttgagatagagctttg

SEQ ID NO: 36842 - DNA, 21 bp, Artificial Sequence
  Synthetic Construct
aaccccttgacggcccatctt

SEQ ID NO: 36843 - DNA, 20 bp, Artificial Sequence
  Synthetic Construct
ccaaagggtcgctacaccaa

SEQ ID NO: 36844 - DNA, 24 bp, Artificial Sequence
  Synthetic Construct
ccagatggaaaagccatcgtggaa

SEQ ID NO: 36845 - DNA, 19 bp, Artificial Sequence
  Synthetic Construct
acgaggcccagctgaacaa

SEQ ID NO: 36846 - DNA, 24 bp, Artificial Sequence
  Synthetic Construct
cctcagcttccccagatacctgtt

SEQ ID NO: 36847 - DNA, 22 bp, Artificial Sequence
  Synthetic Construct
ccaggacaggcattgagtgtga

SEQ ID NO: 36848 - DNA, 22 bp, Artificial Sequence
  Synthetic Construct
tccctcagatgcctgctgttac

SEQ ID NO: 36849 - DNA, 21 bp, Artificial Sequence
  Synthetic Construct
cctgctcgactctgctattgt

SEQ ID NO: 36850 - DNA, 23 bp, Artificial Sequence
  Synthetic Construct
agaaatcaatggggtgcagttga

SEQ ID NO: 36851 - DNA, 23 bp, Artificial Sequence
  Synthetic Construct
ggcacttccccatcactctttct

SEQ ID NO: 36852 - DNA, 20 bp, Artificial Sequence
  Synthetic Construct
gggtggcctgagctaagagt

SEQ ID NO: 36853 - DNA, 19 bp, Artificial Sequence
  Synthetic Construct
agtcaccccactgcaccat

SEQ ID NO: 36854 - DNA, 20 bp, Artificial Sequence
  Synthetic Construct
ggcagaaggggaagcaaaca

SEQ ID NO: 36855 - DNA, 20 bp, Artificial Sequence
  Synthetic Construct
tgggttgctgcagactcaac

SEQ ID NO: 36856 - DNA, 23 bp, Artificial Sequence
  Synthetic Construct
ttgactgctactcccatggaatc

SEQ ID NO: 36857 - DNA, 24 bp, Artificial Sequence
  Synthetic Construct
ctgagagcttaaactggacacaca

SEQ ID NO: 36858 - DNA, 24 bp, Artificial Sequence
  Synthetic Construct
aggaacttccctctcctttactca

SEQ ID NO: 36859 - DNA, 22 bp, Artificial Sequence
  Synthetic Construct
tgggacacctagaccacctaga

SEQ ID NO: 36860 - DNA, 20 bp, Artificial Sequence
  Synthetic Construct
accaggtcccagacctcaca

SEQ ID NO: 36861 - DNA, 25 bp, Artificial Sequence
  Synthetic Construct
gcacacaaaatgaggataggcaact

SEQ ID NO: 36862 - DNA, 24 bp, Artificial Sequence
  Synthetic Construct
cacttcccagttacccctcagttc

SEQ ID NO: 36863 - DNA, 22 bp, Artificial Sequence
  Synthetic Construct
cctcaaccttctgggctcaaac

SEQ ID NO: 36864 - DNA, 22 bp, Artificial Sequence
  Synthetic Construct
agaggtaggcacagagggacta

SEQ ID NO: 36865 - DNA, 20 bp, Artificial Sequence
  Synthetic Construct
ggccttagggacacccaaca

SEQ ID NO: 36866 - DNA, 24 bp, Artificial Sequence
  Synthetic Construct
cacacatgccctgatcttgcctaa

SEQ ID NO: 36867 - DNA, 23 bp, Artificial Sequence
  Synthetic Construct
cacattaggccaagatccactgt

SEQ ID NO: 36868 - DNA, 24 bp, Artificial Sequence
  Synthetic Construct
gttgatcatcatgcaggtgggaaa

SEQ ID NO: 36869 - DNA, 24 bp, Artificial Sequence
  Synthetic Construct
gcccttttcagctgtaatgtgatg

SEQ ID NO: 36870 - DNA, 21 bp, Artificial Sequence
  Synthetic Construct
ggacgtgaagagaagcggttt

SEQ ID NO: 36871 - DNA, 24 bp, Artificial Sequence
  Synthetic Construct
cccacatgtccacctgacttgcat

SEQ ID NO: 36872 - DNA, 20 bp, Artificial Sequence
  Synthetic Construct
aaccagaccctcccaactct

SEQ ID NO: 36873 - DNA, 20 bp, Artificial Sequence
  Synthetic Construct
aggcgaagagctgtgtcaac

SEQ ID NO: 36874 - DNA, 20 bp, Artificial Sequence
  Synthetic Construct
tgggctgaccactgactaca

SEQ ID NO: 36875 - DNA, 22 bp, Artificial Sequence
  Synthetic Construct
ccgaagtcgtgtcatcggaagt

SEQ ID NO: 36876 - DNA, 23 bp, Artificial Sequence
  Synthetic Construct
gctggattagagtaggggcaatg

SEQ ID NO: 36877 - DNA, 20 bp, Artificial Sequence
  Synthetic Construct
tccgtctcaggagggtttca

SEQ ID NO: 36878 - DNA, 24 bp, Artificial Sequence
  Synthetic Construct
ctgcctccttcgatcttctggaaa

SEQ ID NO: 36879 - DNA, 21 bp, Artificial Sequence
  Synthetic Construct
gtccccagccaaactttccaa

SEQ ID NO: 36880 - DNA, 25 bp, Artificial Sequence
  Synthetic Construct
caggtagtttgtcgagagcaagtca

SEQ ID NO: 36881 - DNA, 22 bp, Artificial Sequence
  Synthetic Construct
acagaccagagtggggacttgt

SEQ ID NO: 36882 - DNA, 22 bp, Artificial Sequence
  Synthetic Construct
tcctccagtttccacgggagat

SEQ ID NO: 36883 - DNA, 23 bp, Artificial Sequence
  Synthetic Construct
gagtctcttgaggcacttagcat

SEQ ID NO: 36884 - DNA, 23 bp, Artificial Sequence
  Synthetic Construct
ggacgttcaaaccctgatgaaag

SEQ ID NO: 36885 - DNA, 20 bp, Artificial Sequence
  Synthetic Construct
acaatgctcccgaggtgaga

SEQ ID NO: 36886 - DNA, 20 bp, Artificial Sequence
  Synthetic Construct
actgatggaggtggcctgaa

SEQ ID NO: 36887 - DNA, 25 bp, Artificial Sequence
  Synthetic Construct
cagctaaatccaacaggctatgaca

SEQ ID NO: 36888 - DNA, 22 bp, Artificial Sequence
  Synthetic Construct
gccaagaaaggtcgcctcaatg

SEQ ID NO: 36889 - DNA, 26 bp, Artificial Sequence
  Synthetic Construct
gccatcactgtatcctctccatcact

SEQ ID NO: 36890 - DNA, 20 bp, Artificial Sequence
  Synthetic Construct
gggtccctctgcctggaatg

SEQ ID NO: 36891 - DNA, 21 bp, Artificial Sequence
  Synthetic Construct
gcccctgcagtgtcaggaaat

SEQ ID NO: 36892 - DNA, 24 bp, Artificial Sequence
  Synthetic Construct
ggaacaaaaccatggatggctgat

SEQ ID NO: 36893 - DNA, 19 bp, Artificial Sequence
  Synthetic Construct
gcgaaacgcgtgccttaca

SEQ ID NO: 36894 - DNA, 22 bp, Artificial Sequence
  Synthetic Construct
ccacacttcggcttgaccaact

SEQ ID NO: 36895 - DNA, 21 bp, Artificial Sequence
  Synthetic Construct
gccctgcctaaccacatgttc

SEQ ID NO: 36896 - DNA, 24 bp, Artificial Sequence
  Synthetic Construct
ctcccttaaggaaacccacagttg

SEQ ID NO: 36897 - DNA, 22 bp, Artificial Sequence
  Synthetic Construct
cttgacttgctgaggactgaca

SEQ ID NO: 36898 - DNA, 21 bp, Artificial Sequence
  Synthetic Construct
gggaaggtccgcagagacaat

SEQ ID NO: 36899 - DNA, 24 bp, Artificial Sequence
  Synthetic Construct
gacatggaaaaggctggaatgtag

SEQ ID NO: 36900 - DNA, 23 bp, Artificial Sequence
  Synthetic Construct
tgctgatccacatacctcctcaa

SEQ ID NO: 36901 - DNA, 25 bp, Artificial Sequence
  Synthetic Construct
cttcattgaatctccagtgggaaca

SEQ ID NO: 36902 - DNA, 21 bp, Artificial Sequence
  Synthetic Construct
tcctggtcttctcccagtgtt

SEQ ID NO: 36903 - DNA, 24 bp, Artificial Sequence
  Synthetic Construct
ccaaaatagctccccaaacccttt

SEQ ID NO: 36904 - DNA, 19 bp, Artificial Sequence
  Synthetic Construct
agcccaggacctgcccaaa

SEQ ID NO: 36905 - DNA, 20 bp, Artificial Sequence
  Synthetic Construct
ttgcccttgctggtgctgaa

SEQ ID NO: 36906 - DNA, 22 bp, Artificial Sequence
  Synthetic Construct
cactgactggagctgggttcaa

SEQ ID NO: 36907 - DNA, 24 bp, Artificial Sequence
  Synthetic Construct
acgagccagagacatccttaaaaa

SEQ ID NO: 36908 - DNA, 20 bp, Artificial Sequence
  Synthetic Construct
ctccaactgcttggcctctt

SEQ ID NO: 36909 - DNA, 22 bp, Artificial Sequence
  Synthetic Construct
acttctttgagcttcccagcat

SEQ ID NO: 36910 - DNA, 25 bp, Artificial Sequence
  Synthetic Construct
agaagagatgtccttccctgagaat

SEQ ID NO: 36911 - DNA, 24 bp, Artificial Sequence
  Synthetic Construct
gtggcatttgaagacactcgtaac

SEQ ID NO: 36912 - DNA, 23 bp, Artificial Sequence
  Synthetic Construct
ggaatctacaccactgcctctct

SEQ ID NO: 36913 - DNA, 23 bp, Artificial Sequence
  Synthetic Construct
caccacactacagccacatgagt

SEQ ID NO: 36914 - DNA, 25 bp, Artificial Sequence
  Synthetic Construct
gtctcgaggagaatagcatgtcttg

SEQ ID NO: 36915 - DNA, 28 bp, Artificial Sequence
  Synthetic Construct
ctgtgtaaactataccagggagactaag

SEQ ID NO: 36916 - DNA, 24 bp, Artificial Sequence
  Synthetic Construct
cagctacttcatcccttccctact

SEQ ID NO: 36917 - DNA, 18 bp, Artificial Sequence
  Synthetic Construct
cagcaagcccgtccagtt

SEQ ID NO: 36918 - DNA, 22 bp, Artificial Sequence
  Synthetic Construct
gctcagcccaaagcctcaaaac

SEQ ID NO: 36919 - DNA, 22 bp, Artificial Sequence
  Synthetic Construct
gctgccattcaagaacagcaat

SEQ ID NO: 36920 - DNA, 25 bp, Artificial Sequence
  Synthetic Construct
gagatggaggttatgcatggattct

SEQ ID NO: 36921 - DNA, 23 bp, Artificial Sequence
  Synthetic Construct
gccatcaccatggatgaggaaag

SEQ ID NO: 36922 - DNA, 21 bp, Artificial Sequence
  Synthetic Construct
cagacaggaatgggcatgcaa

SEQ ID NO: 36923 - DNA, 23 bp, Artificial Sequence
  Synthetic Construct
ttagcgatcccagttcacctaac

SEQ ID NO: 36924 - DNA, 25 bp, Artificial Sequence
  Synthetic Construct
gcagctgaaatctgccaccttaact

SEQ ID NO: 36925 - DNA, 21 bp, Artificial Sequence
  Synthetic Construct
tgcaggacagtgggctccaaa

SEQ ID NO: 36926 - DNA, 24 bp, Artificial Sequence
  Synthetic Construct
gcacaggaatgcatgaagcgaaac

SEQ ID NO: 36927 - DNA, 27 bp, Artificial Sequence
  Synthetic Construct
ggacttgccctgatttctttcctgagt

SEQ ID NO: 36928 - DNA, 26 bp, Artificial Sequence
  Synthetic Construct
gtctctatctcagtctaaggggatct

SEQ ID NO: 36929 - DNA, 27 bp, Artificial Sequence
  Synthetic Construct
cacacatctggtcatttctccttcaac

SEQ ID NO: 36930 - DNA, 20 bp, Artificial Sequence
  Synthetic Construct
tcgtggtgcatgccgatagt

SEQ ID NO: 36931 - DNA, 20 bp, Artificial Sequence
  Synthetic Construct
cagctgcaaggtgcatggtt

SEQ ID NO: 36932 - DNA, 22 bp, Artificial Sequence
  Synthetic Construct
ggaacctgcagcgttggtaaga

SEQ ID NO: 36933 - DNA, 20 bp, Artificial Sequence
  Synthetic Construct
ggtgtgtgtggtgtgctgat

SEQ ID NO: 36934 - DNA, 22 bp, Artificial Sequence
  Synthetic Construct
ggatcctgtgaagaggccaaat

SEQ ID NO: 36935 - DNA, 24 bp, Artificial Sequence
  Synthetic Construct
cctctctgggcattatggttctga

SEQ ID NO: 36936 - DNA, 20 bp, Artificial Sequence
  Synthetic Construct
ggctgtgtgtccgctgtgta

SEQ ID NO: 36937 - DNA, 22 bp, Artificial Sequence
  Synthetic Construct
ccgtggctgtctgagatacact

SEQ ID NO: 36938 - DNA, 24 bp, Artificial Sequence
  Synthetic Construct
cgtcaagttcaagtctcacctttc

SEQ ID NO: 36939 - DNA, 20 bp, Artificial Sequence
  Synthetic Construct
tgctgtctgcccacagactt

SEQ ID NO: 36940 - DNA, 20 bp, Artificial Sequence
  Synthetic Construct
gcgctgctgtctctggaaat

SEQ ID NO: 36941 - DNA, 26 bp, Artificial Sequence
  Synthetic Construct
gacagagttcctgtcggaaaacaaag

SEQ ID NO: 36942 - DNA, 19 bp, Artificial Sequence
  Synthetic Construct
catcgcagcgagctctcaa

SEQ ID NO: 36943 - DNA, 22 bp, Artificial Sequence
  Synthetic Construct
ccaagttcgcacacctcctgaa

SEQ ID NO: 36944 - DNA, 25 bp, Artificial Sequence
  Synthetic Construct
cactctccagcatcttaaggaacaa

SEQ ID NO: 36945 - DNA, 22 bp, Artificial Sequence
  Synthetic Construct
gggaagcttcaggcttggttca

SEQ ID NO: 36946 - DNA, 23 bp, Artificial Sequence
  Synthetic Construct
gccatccagaaccattcctgtca

SEQ ID NO: 36947 - DNA, 22 bp, Artificial Sequence
  Synthetic Construct
ttggagagcagtttgagcatct

SEQ ID NO: 36948 - DNA, 20 bp, Artificial Sequence
  Synthetic Construct
cgtgtaggctgggaccacat

SEQ ID NO: 36949 - DNA, 20 bp, Artificial Sequence
  Synthetic Construct
ggaaatggccaccagagctt

SEQ ID NO: 36950 - DNA, 23 bp, Artificial Sequence
  Synthetic Construct
agaggaagagggtggagaagtag

SEQ ID NO: 36951 - DNA, 23 bp, Artificial Sequence
  Synthetic Construct
gcgggaaaatgaccagagcagat

SEQ ID NO: 36952 - DNA, 22 bp, Artificial Sequence
  Synthetic Construct
ctgggcaaccgtcaggattatg

SEQ ID NO: 36953 - DNA, 24 bp, Artificial Sequence
  Synthetic Construct
caaaccaaagtgaacaccaacagt

SEQ ID NO: 36954 - DNA, 21 bp, Artificial Sequence
  Synthetic Construct
tcacagtgtgccacggattac

SEQ ID NO: 36955 - DNA, 22 bp, Artificial Sequence
  Synthetic Construct
ccttgcacagagcggaaaggat

SEQ ID NO: 36956 - DNA, 20 bp, Artificial Sequence
  Synthetic Construct
tctgcttccagtggggactt

SEQ ID NO: 36957 - DNA, 22 bp, Artificial Sequence
  Synthetic Construct
cctcacttccaacacagggaat

SEQ ID NO: 36958 - DNA, 22 bp, Artificial Sequence
  Synthetic Construct
cctgaggtcaccacgctagttg

SEQ ID NO: 36959 - DNA, 22 bp, Artificial Sequence
  Synthetic Construct
ccgtcacccaaccctcaaaagt

SEQ ID NO: 36960 - DNA, 22 bp, Artificial Sequence
  Synthetic Construct
accagcacctagatgccactgt

SEQ ID NO: 36961 - DNA, 20 bp, Artificial Sequence
  Synthetic Construct
tgcatgatccaggcgtcaac

SEQ ID NO: 36962 - DNA, 23 bp, Artificial Sequence
  Synthetic Construct
gacttagggaagtggtgctggat

SEQ ID NO: 36963 - DNA, 21 bp, Artificial Sequence
  Synthetic Construct
ccccaggtctgtagcaagaca

SEQ ID NO: 36964 - DNA, 21 bp, Artificial Sequence
  Synthetic Construct
gcctccactgagcttcagcaa

SEQ ID NO: 36965 - DNA, 19 bp, Artificial Sequence
  Synthetic Construct
agccgctcccttccttttc

SEQ ID NO: 36966 - DNA, 20 bp, Artificial Sequence
  Synthetic Construct
actgcagcctcaacctctca

SEQ ID NO: 36967 - DNA, 26 bp, Artificial Sequence
  Synthetic Construct
ccagagtcagcagtaggaaggagttc

SEQ ID NO: 36968 - DNA, 23 bp, Artificial Sequence
  Synthetic Construct
gcctttagctctccactcacaga

SEQ ID NO: 36969 - DNA, 21 bp, Artificial Sequence
  Synthetic Construct
gactcggttgcacccaaaatg

SEQ ID NO: 36970 - DNA, 22 bp, Artificial Sequence
  Synthetic Construct
gcaagacacaggcactctgatg

SEQ ID NO: 36971 - DNA, 24 bp, Artificial Sequence
  Synthetic Construct
tcctaggatctgcactaacacgta

SEQ ID NO: 36972 - DNA, 24 bp, Artificial Sequence
  Synthetic Construct
ggggaaggaattcagggagagaca

SEQ ID NO: 36973 - DNA, 20 bp, Artificial Sequence
  Synthetic Construct
ggcttgaggccatcgtgcta

SEQ ID NO: 36974 - DNA, 22 bp, Artificial Sequence
  Synthetic Construct
ccctgtggatctacccctcttt

SEQ ID NO: 36975 - DNA, 20 bp, Artificial Sequence
  Synthetic Construct
aaggggcatggtggcgaaga

SEQ ID NO: 36976 - DNA, 23 bp, Artificial Sequence
  Synthetic Construct
ctccccactaaggatgaggaact

SEQ ID NO: 36977 - DNA, 25 bp, Artificial Sequence
  Synthetic Construct
ggctggctaacaatgggttatctct

SEQ ID NO: 36978 - DNA, 22 bp, Artificial Sequence
  Synthetic Construct
agagaggcagagggacatttga

SEQ ID NO: 36979 - DNA, 24 bp, Artificial Sequence
  Synthetic Construct
ccattcgcagtaattctccaccta

SEQ ID NO: 36980 - DNA, 24 bp, Artificial Sequence
  Synthetic Construct
gcattgagaaactgaagcacatct

SEQ ID NO: 36981 - DNA, 23 bp, Artificial Sequence
  Synthetic Construct
cagcttaattctcccagcagcaa

SEQ ID NO: 36982 - DNA, 22 bp, Artificial Sequence
  Synthetic Construct
ccaggcaagtgaccctgtgtta

SEQ ID NO: 36983 - DNA, 23 bp, Artificial Sequence
  Synthetic Construct
gtgcaatcgtgctttccaagaca

SEQ ID NO: 36984 - DNA, 22 bp, Artificial Sequence
  Synthetic Construct
ggtgtggtgggaggatcacttg

SEQ ID NO: 36985 - DNA, 24 bp, Artificial Sequence
  Synthetic Construct
tcctctaaggagtggcatgatcta

SEQ ID NO: 36986 - DNA, 23 bp, Artificial Sequence
  Synthetic Construct
tgcaagtctgtgtcctactgaac

SEQ ID NO: 36987 - DNA, 22 bp, Artificial Sequence
  Synthetic Construct
ccctttgctcagccatgcatca

SEQ ID NO: 36988 - DNA, 26 bp, Artificial Sequence
  Synthetic Construct
ggcattgatcacaagtgagactggaa

SEQ ID NO: 36989 - DNA, 25 bp, Artificial Sequence
  Synthetic Construct
cctgacatggaagggtttcctggta

SEQ ID NO: 36990 - DNA, 24 bp, Artificial Sequence
  Synthetic Construct
cgctaatgaattgcctgggacata

SEQ ID NO: 36991 - DNA, 23 bp, Artificial Sequence
  Synthetic Construct
ccctacagaacggttgagaggtt

SEQ ID NO: 36992 - DNA, 26 bp, Artificial Sequence
  Synthetic Construct
gtcctccttattcctttctgctcttg

SEQ ID NO: 36993 - DNA, 20 bp, Artificial Sequence
  Synthetic Construct
tggcagttttcagccacaca

SEQ ID NO: 36994 - DNA, 20 bp, Artificial Sequence
  Synthetic Construct
tgggtgcataaggcggtaca

SEQ ID NO: 36995 - DNA, 23 bp, Artificial Sequence
  Synthetic Construct
gtcactgggaacgagtggttcaa

SEQ ID NO: 36996 - DNA, 23 bp, Artificial Sequence
  Synthetic Construct
gctctcagcattttccaggcatt

SEQ ID NO: 36997 - DNA, 23 bp, Artificial Sequence
  Synthetic Construct
gtggagcttaacccatgaaggtt

SEQ ID NO: 36998 - DNA, 23 bp, Artificial Sequence
  Synthetic Construct
ccacaagttggacacccttggat

SEQ ID NO: 36999 - DNA, 20 bp, Artificial Sequence
  Synthetic Construct
ctctgcctggttgggattgt

SEQ ID NO: 37000 - DNA, 22 bp, Artificial Sequence
  Synthetic Construct
actgttttcagcagacctgtgt

SEQ ID NO: 37001 - DNA, 22 bp, Artificial Sequence
  Synthetic Construct
gcctggatgtctgccatgatct

SEQ ID NO: 37002 - DNA, 22 bp, Artificial Sequence
  Synthetic Construct
cctcccatgttggaggaagcat

SEQ ID NO: 37003 - DNA, 24 bp, Artificial Sequence
  Synthetic Construct
ggggatcaataagccatcgataca

SEQ ID NO: 37004 - DNA, 20 bp, Artificial Sequence
  Synthetic Construct
ccttggttgtgcctccactt

SEQ ID NO: 37005 - DNA, 25 bp, Artificial Sequence
  Synthetic Construct
cccttgtctaaccagtgatactgaa

SEQ ID NO: 37006 - DNA, 25 bp, Artificial Sequence
  Synthetic Construct
ttcttctgcagacacaaatggaaag

SEQ ID NO: 37007 - DNA, 21 bp, Artificial Sequence
  Synthetic Construct
tccctcgccagtccatcttct

SEQ ID NO: 37008 - DNA, 22 bp, Artificial Sequence
  Synthetic Construct
agtcccacccctcccctataaa

SEQ ID NO: 37009 - DNA, 20 bp, Artificial Sequence
  Synthetic Construct
tgccaagtctgctccaggaa

SEQ ID NO: 37010 - DNA, 25 bp, Artificial Sequence
  Synthetic Construct
gtgctctgaaagtgtgggttcttct

SEQ ID NO: 37011 - DNA, 26 bp, Artificial Sequence
  Synthetic Construct
ccttgaaaacactcagggactagaag

SEQ ID NO: 37012 - DNA, 22 bp, Artificial Sequence
  Synthetic Construct
ccccatgtagcagggtcttctt

SEQ ID NO: 37013 - DNA, 24 bp, Artificial Sequence
  Synthetic Construct
ttttccattgagagaggtgcagat

SEQ ID NO: 37014 - DNA, 23 bp, Artificial Sequence
  Synthetic Construct
gattttcagccagccatcctttg

SEQ ID NO: 37015 - DNA, 23 bp, Artificial Sequence
  Synthetic Construct
ggatgcagcaaaagtatgccatt

SEQ ID NO: 37016 - DNA, 22 bp, Artificial Sequence
  Synthetic Construct
tggagacagcaggaaccacaga

SEQ ID NO: 37017 - DNA, 22 bp, Artificial Sequence
  Synthetic Construct
gagcctgttgtgacctgattct

SEQ ID NO: 37018 - DNA, 22 bp, Artificial Sequence
  Synthetic Construct
acgattctggaggcaaggagta

SEQ ID NO: 37019 - DNA, 23 bp, Artificial Sequence
  Synthetic Construct
cggctatctctgtctccatcaac

SEQ ID NO: 37020 - DNA, 23 bp, Artificial Sequence
  Synthetic Construct
cccacatggtagcctctttcact

SEQ ID NO: 37021 - DNA, 21 bp, Artificial Sequence
  Synthetic Construct
ggagcagggtgttttgctgtt

SEQ ID NO: 37022 - DNA, 24 bp, Artificial Sequence
  Synthetic Construct
gggcttgggtgtgggagaaaagta

SEQ ID NO: 37023 - DNA, 23 bp, Artificial Sequence
  Synthetic Construct
agaagagcagagcaggtttgatg

SEQ ID NO: 37024 - DNA, 24 bp, Artificial Sequence
  Synthetic Construct
cctcatcaagccccatagcctcat

SEQ ID NO: 37025 - DNA, 30 bp, Artificial Sequence
  Synthetic Construct
ctgaggctttaactctttgactcgaatatg

SEQ ID NO: 37026 - DNA, 24 bp, Artificial Sequence
  Synthetic Construct
gaggatggaacctgtgaaaaccta

SEQ ID NO: 37027 - DNA, 21 bp, Artificial Sequence
  Synthetic Construct
actcttggcttgcttgcattg

SEQ ID NO: 37028 - DNA, 22 bp, Artificial Sequence
  Synthetic Construct
ctgctagagcttctggccaagt

SEQ ID NO: 37029 - DNA, 24 bp, Artificial Sequence
  Synthetic Construct
acaaagatgatgtcacctgcctaa

SEQ ID NO: 37030 - DNA, 26 bp, Artificial Sequence
  Synthetic Construct
ggttatgtcaatgagagcagcctttg

SEQ ID NO: 37031 - DNA, 22 bp, Artificial Sequence
  Synthetic Construct
cacttagccgtgcaggaacaac

SEQ ID NO: 37032 - DNA, 21 bp, Artificial Sequence
  Synthetic Construct
gggcaggacttgcatcaggaa

SEQ ID NO: 37033 - DNA, 24 bp, Artificial Sequence
  Synthetic Construct
aatatgcagactcaaggtcacact

SEQ ID NO: 37034 - DNA, 23 bp, Artificial Sequence
  Synthetic Construct
ggagatcccacccagtgaggaaa

SEQ ID NO: 37035 - DNA, 21 bp, Artificial Sequence
  Synthetic Construct
tgctcacatcacatgcccatt

SEQ ID NO: 37036 - DNA, 19 bp, Artificial Sequence
  Synthetic Construct
gccttcctccagccaccaa

SEQ ID NO: 37037 - DNA, 21 bp, Artificial Sequence
  Synthetic Construct
gccaaagtccacggacagaca

SEQ ID NO: 37038 - DNA, 20 bp, Artificial Sequence
  Synthetic Construct
cttgcagccccttacacaca

SEQ ID NO: 37039 - DNA, 24 bp, Artificial Sequence
  Synthetic Construct
ggactgattggcaaagacctcaca

SEQ ID NO: 37040 - DNA, 23 bp, Artificial Sequence
  Synthetic Construct
cgagccacagtcattcagagcat

SEQ ID NO: 37041 - DNA, 21 bp, Artificial Sequence
  Synthetic Construct
ggctctcagctgatgcttagt

SEQ ID NO: 37042 - DNA, 23 bp, Artificial Sequence
  Synthetic Construct
tggattacatttgccctctgcaa

SEQ ID NO: 37043 - DNA, 22 bp, Artificial Sequence
  Synthetic Construct
ggcccaaggttcctgtgtatca

SEQ ID NO: 37044 - DNA, 24 bp, Artificial Sequence
  Synthetic Construct
ccagactgatgatcctggatgaag

SEQ ID NO: 37045 - DNA, 24 bp, Artificial Sequence
  Synthetic Construct
caggtttccaccagaaggttgtct

SEQ ID NO: 37046 - DNA, 23 bp, Artificial Sequence
  Synthetic Construct
ccttttgctcacagggatagtca

SEQ ID NO: 37047 - DNA, 22 bp, Artificial Sequence
  Synthetic Construct
ggggaaaacaatgacccaccaa

SEQ ID NO: 37048 - DNA, 22 bp, Artificial Sequence
  Synthetic Construct
ggggatacagtaggagggcaaa

SEQ ID NO: 37049 - DNA, 22 bp, Artificial Sequence
  Synthetic Construct
cacaccaagtggagaggcaaga

SEQ ID NO: 37050 - DNA, 25 bp, Artificial Sequence
  Synthetic Construct
ggggaacctcctcttatttccttca

SEQ ID NO: 37051 - DNA, 25 bp, Artificial Sequence
  Synthetic Construct
cccagcctttctagcaaaagcaaat

SEQ ID NO: 37052 - DNA, 24 bp, Artificial Sequence
  Synthetic Construct
ggagcaggtgatagctcttaaaca

SEQ ID NO: 37053 - DNA, 22 bp, Artificial Sequence
  Synthetic Construct
ctgtcactgcacctgtcaaaac

SEQ ID NO: 37054 - DNA, 26 bp, Artificial Sequence
  Synthetic Construct
tcctatcctccttgtttctgctaaag

SEQ ID NO: 37055 - DNA, 21 bp, Artificial Sequence
  Synthetic Construct
atgaggcttcactggctcatc

SEQ ID NO: 37056 - DNA, 21 bp, Artificial Sequence
  Synthetic Construct
tgccctgcatcctccttcaca

SEQ ID NO: 37057 - DNA, 20 bp, Artificial Sequence
  Synthetic Construct
aacgccagagcactgcattc

SEQ ID NO: 37058 - DNA, 26 bp, Artificial Sequence
  Synthetic Construct
gagcagaaatcttccaccttgtctac

SEQ ID NO: 37059 - DNA, 21 bp, Artificial Sequence
  Synthetic Construct
cccctgcctcacagtcttact

SEQ ID NO: 37060 - DNA, 20 bp, Artificial Sequence
  Synthetic Construct
acatggagcgttcgcacttc

SEQ ID NO: 37061 - DNA, 22 bp, Artificial Sequence
  Synthetic Construct
ccaagccctcctgcctcatatc

SEQ ID NO: 37062 - DNA, 25 bp, Artificial Sequence
  Synthetic Construct
gcattagctcggtttctaggcaaag

SEQ ID NO: 37063 - DNA, 23 bp, Artificial Sequence
  Synthetic Construct
gtgttctgagtttgggtgacaac

SEQ ID NO: 37064 - DNA, 22 bp, Artificial Sequence
  Synthetic Construct
ccccacagcaactctgcacata

SEQ ID NO: 37065 - DNA, 25 bp, Artificial Sequence
  Synthetic Construct
ccctagattttgtgacccagtgaac

SEQ ID NO: 37066 - DNA, 19 bp, Artificial Sequence
  Synthetic Construct
acagcccggtgctggttca

SEQ ID NO: 37067 - DNA, 19 bp, Artificial Sequence
  Synthetic Construct
agaagccagccggtctgta

SEQ ID NO: 37068 - DNA, 21 bp, Artificial Sequence
  Synthetic Construct
ccactgcaggcacgttgtaga

SEQ ID NO: 37069 - DNA, 22 bp, Artificial Sequence
  Synthetic Construct
ttcaaacttcagctccccaagt

SEQ ID NO: 37070 - DNA, 21 bp, Artificial Sequence
  Synthetic Construct
cctctggggccagaaagaaca

SEQ ID NO: 37071 - DNA, 23 bp, Artificial Sequence
  Synthetic Construct
ggtgaatccagctcattccttca

SEQ ID NO: 37072 - DNA, 23 bp, Artificial Sequence
  Synthetic Construct
ggaagagcttagggcaaggaatc

SEQ ID NO: 37073 - DNA, 22 bp, Artificial Sequence
  Synthetic Construct
caagtcccttccacctggagta

SEQ ID NO: 37074 - DNA, 22 bp, Artificial Sequence
  Synthetic Construct
aggttacgcacatgaagagcat

SEQ ID NO: 37075 - DNA, 22 bp, Artificial Sequence
  Synthetic Construct
agggattcccacactggggttt

SEQ ID NO: 37076 - DNA, 21 bp, Artificial Sequence
  Synthetic Construct
gcagcccaagtctcagggttt

SEQ ID NO: 37077 - DNA, 24 bp, Artificial Sequence
  Synthetic Construct
tgacatcaatgtggatgtgcgata

SEQ ID NO: 37078 - DNA, 22 bp, Artificial Sequence
  Synthetic Construct
gcacaaggctagcgtccaaatg

SEQ ID NO: 37079 - DNA, 23 bp, Artificial Sequence
  Synthetic Construct
tgctgtaaacttcaggccaatgt

SEQ ID NO: 37080 - DNA, 19 bp, Artificial Sequence
  Synthetic Construct
acaggcctgggtgcaaact

SEQ ID NO: 37081 - DNA, 20 bp, Artificial Sequence
  Synthetic Construct
aagggtggggacgtgtgttt

SEQ ID NO: 37082 - DNA, 19 bp, Artificial Sequence
  Synthetic Construct
tcagcccttgcacaacaca

SEQ ID NO: 37083 - DNA, 22 bp, Artificial Sequence
  Synthetic Construct
gatccaggctgggactgaaatc

SEQ ID NO: 37084 - DNA, 24 bp, Artificial Sequence
  Synthetic Construct
gtgatcatctgggatggagacttg

SEQ ID NO: 37085 - DNA, 23 bp, Artificial Sequence
  Synthetic Construct
gctccatatccttccacctcaga

SEQ ID NO: 37086 - DNA, 24 bp, Artificial Sequence
  Synthetic Construct
agtctacactcaagaggggagttc

SEQ ID NO: 37087 - DNA, 24 bp, Artificial Sequence
  Synthetic Construct
cgaagcatgtctctgtggtagcaa

SEQ ID NO: 37088 - DNA, 19 bp, Artificial Sequence
  Synthetic Construct
aggtgggtgcacttgcatt

SEQ ID NO: 37089 - DNA, 20 bp, Artificial Sequence
  Synthetic Construct
accaggcttccagacactca

SEQ ID NO: 37090 - DNA, 21 bp, Artificial Sequence
  Synthetic Construct
actccgacagccagtggtact

SEQ ID NO: 37091 - DNA, 22 bp, Artificial Sequence
  Synthetic Construct
tctgtcactgggaaccttgact

SEQ ID NO: 37092 - DNA, 20 bp, Artificial Sequence
  Synthetic Construct
gcagctgagagtgcgctttg

SEQ ID NO: 37093 - DNA, 21 bp, Artificial Sequence
  Synthetic Construct
gcagctgagggtgatgtgtga

SEQ ID NO: 37094 - DNA, 20 bp, Artificial Sequence
  Synthetic Construct
catgaaggtgcctgctgtgt

SEQ ID NO: 37095 - DNA, 22 bp, Artificial Sequence
  Synthetic Construct
acactcaggctcagggaagtga

SEQ ID NO: 37096 - DNA, 19 bp, Artificial Sequence
  Synthetic Construct
ccccaacagggctgactgt

SEQ ID NO: 37097 - DNA, 21 bp, Artificial Sequence
  Synthetic Construct
tggccctgggtaccaccattt

SEQ ID NO: 37098 - DNA, 20 bp, Artificial Sequence
  Synthetic Construct
taaggccaccagcggaaagt

SEQ ID NO: 37099 - DNA, 22 bp, Artificial Sequence
  Synthetic Construct
gagatggggtcccatagcttga

SEQ ID NO: 37100 - DNA, 19 bp, Artificial Sequence
  Synthetic Construct
tccacagggcccacacaga

SEQ ID NO: 37101 - DNA, 20 bp, Artificial Sequence
  Synthetic Construct
atgcaggctgggtgctcttt

SEQ ID NO: 37102 - DNA, 21 bp, Artificial Sequence
  Synthetic Construct
agcctgctggatggagagaga

SEQ ID NO: 37103 - DNA, 27 bp, Artificial Sequence
  Synthetic Construct
gtctggtaataggaggaagtgtaacat

SEQ ID NO: 37104 - DNA, 19 bp, Artificial Sequence
  Synthetic Construct
cccttccagcctggtcact

SEQ ID NO: 37105 - DNA, 30 bp, Artificial Sequence
  Synthetic Construct
gagaagactaaaataccctttccactgtca

SEQ ID NO: 37106 - DNA, 23 bp, Artificial Sequence
  Synthetic Construct
ctgtgatctccctgttggctttc

SEQ ID NO: 37107 - DNA, 24 bp, Artificial Sequence
  Synthetic Construct
cctctgaaaactgctgaggtgctt

SEQ ID NO: 37108 - DNA, 19 bp, Artificial Sequence
  Synthetic Construct
tggccagagggaagcaaag

SEQ ID NO: 37109 - DNA, 22 bp, Artificial Sequence
  Synthetic Construct
gacagcccttcctgcataagaa

SEQ ID NO: 37110 - DNA, 23 bp, Artificial Sequence
  Synthetic Construct
caggaaaagttccaggagaccat

SEQ ID NO: 37111 - DNA, 24 bp, Artificial Sequence
  Synthetic Construct
gtcgccttatgtctccttcaaact

SEQ ID NO: 37112 - DNA, 24 bp, Artificial Sequence
  Synthetic Construct
gtcagtatctctgtggctcacact

SEQ ID NO: 37113 - DNA, 18 bp, Artificial Sequence
  Synthetic Construct
cttggctccaggctgcaa

SEQ ID NO: 37114 - DNA, 27 bp, Artificial Sequence
  Synthetic Construct
ccacaggtgtttccaagtaggatctca

SEQ ID NO: 37115 - DNA, 20 bp, Artificial Sequence
  Synthetic Construct
tctctgcctgtgtcctgcaa

SEQ ID NO: 37116 - DNA, 24 bp, Artificial Sequence
  Synthetic Construct
cccattggccagaatttagtctca

SEQ ID NO: 37117 - DNA, 22 bp, Artificial Sequence
  Synthetic Construct
acaggggtggaagtgaggaaag

SEQ ID NO: 37118 - DNA, 22 bp, Artificial Sequence
  Synthetic Construct
tcacatttggccagtgcttagt

SEQ ID NO: 37119 - DNA, 20 bp, Artificial Sequence
  Synthetic Construct
tgtgctgcctcagtctgtga

SEQ ID NO: 37120 - DNA, 20 bp, Artificial Sequence
  Synthetic Construct
tgcacttgagccacctcgaa

SEQ ID NO: 37121 - DNA, 22 bp, Artificial Sequence
  Synthetic Construct
ggggcagctgggatgaaataga

SEQ ID NO: 37122 - DNA, 27 bp, Artificial Sequence
  Synthetic Construct
gtgtaatgaatggattggagggactga

SEQ ID NO: 37123 - DNA, 24 bp, Artificial Sequence
  Synthetic Construct
ggcaccttccatctacggttggat

SEQ ID NO: 37124 - DNA, 22 bp, Artificial Sequence
  Synthetic Construct
ccttcagcctaccttgcagtct

SEQ ID NO: 37125 - DNA, 27 bp, Artificial Sequence
  Synthetic Construct
gctctcttctattaccagggaccagta

SEQ ID NO: 37126 - DNA, 20 bp, Artificial Sequence
  Synthetic Construct
ccccatggctgtaagcatca

SEQ ID NO: 37127 - DNA, 22 bp, Artificial Sequence
  Synthetic Construct
cacctaccctcttcccatgcaa

SEQ ID NO: 37128 - DNA, 23 bp, Artificial Sequence
  Synthetic Construct
cacaacacctcacgtcagcatag

SEQ ID NO: 37129 - DNA, 23 bp, Artificial Sequence
  Synthetic Construct
ttggcaggaaacttctaggcaat

SEQ ID NO: 37130 - DNA, 27 bp, Artificial Sequence
  Synthetic Construct
gagactaaggaggaagacagttagaag

SEQ ID NO: 37131 - DNA, 26 bp, Artificial Sequence
  Synthetic Construct
cactccattacacatggaggcatagt

SEQ ID NO: 37132 - DNA, 21 bp, Artificial Sequence
  Synthetic Construct
tcttaggtaccgccctagctt

SEQ ID NO: 37133 - DNA, 24 bp, Artificial Sequence
  Synthetic Construct
cccacatactcccaaatggactgt

SEQ ID NO: 37134 - DNA, 21 bp, Artificial Sequence
  Synthetic Construct
tcccaggggcttcaagtctgt

SEQ ID NO: 37135 - DNA, 24 bp, Artificial Sequence
  Synthetic Construct
gtgactggttcaatagcaccgata

SEQ ID NO: 37136 - DNA, 22 bp, Artificial Sequence
  Synthetic Construct
cagatccagggagcatcccaat

SEQ ID NO: 37137 - DNA, 21 bp, Artificial Sequence
  Synthetic Construct
ggaattgcctccctcgtctct

SEQ ID NO: 37138 - DNA, 22 bp, Artificial Sequence
  Synthetic Construct
cagtagcccatggggaaacaag

SEQ ID NO: 37139 - DNA, 25 bp, Artificial Sequence
  Synthetic Construct
tgcaggtccggatagtaaatagaga

SEQ ID NO: 37140 - DNA, 22 bp, Artificial Sequence
  Synthetic Construct
gagcagaatgcaacgcacaact

SEQ ID NO: 37141 - DNA, 20 bp, Artificial Sequence
  Synthetic Construct
cctgccagcattcaccacaa

SEQ ID NO: 37142 - DNA, 19 bp, Artificial Sequence
  Synthetic Construct
agcagccagcagccactga

SEQ ID NO: 37143 - DNA, 20 bp, Artificial Sequence
  Synthetic Construct
aacaggccagtgagggtgat

SEQ ID NO: 37144 - DNA, 21 bp, Artificial Sequence
  Synthetic Construct
tggtgcaagggtgagggacaa

SEQ ID NO: 37145 - DNA, 23 bp, Artificial Sequence
  Synthetic Construct
ctccaatccctcctagtccctaa

SEQ ID NO: 37146 - DNA, 25 bp, Artificial Sequence
  Synthetic Construct
gtggtaacttgacataagccacttg

SEQ ID NO: 37147 - DNA, 20 bp, Artificial Sequence
  Synthetic Construct
tgccttgcagagcccagaat

SEQ ID NO: 37148 - DNA, 22 bp, Artificial Sequence
  Synthetic Construct
gcagagccaggtgacgttttca

SEQ ID NO: 37149 - DNA, 23 bp, Artificial Sequence
  Synthetic Construct
gcagttgaggtcaaggacaccat

SEQ ID NO: 37150 - DNA, 21 bp, Artificial Sequence
  Synthetic Construct
ggagccgaagcaactggtaca

SEQ ID NO: 37151 - DNA, 22 bp, Artificial Sequence
  Synthetic Construct
gtgtggagggagaagtgtgcaa

SEQ ID NO: 37152 - DNA, 22 bp, Artificial Sequence
  Synthetic Construct
accagccttagccagataggaa

SEQ ID NO: 37153 - DNA, 24 bp, Artificial Sequence
  Synthetic Construct
tgacacttggtgggcaagtaattt

SEQ ID NO: 37154 - DNA, 23 bp, Artificial Sequence
  Synthetic Construct
gaatgaagcagagctcagtgcta

SEQ ID NO: 37155 - DNA, 21 bp, Artificial Sequence
  Synthetic Construct
atcagctcctccccactgttg

SEQ ID NO: 37156 - DNA, 23 bp, Artificial Sequence
  Synthetic Construct
tgcaattttcactgcaccagttc

SEQ ID NO: 37157 - DNA, 23 bp, Artificial Sequence
  Synthetic Construct
gggtctgccccatagatccaaag

SEQ ID NO: 37158 - DNA, 24 bp, Artificial Sequence
  Synthetic Construct
ctgctttaagaggttgggttgaga

SEQ ID NO: 37159 - DNA, 26 bp, Artificial Sequence
  Synthetic Construct
ctctcactgtaaaatgcctgtgaatc

SEQ ID NO: 37160 - DNA, 24 bp, Artificial Sequence
  Synthetic Construct
cttcattacctcccaactggcatt

SEQ ID NO: 37161 - DNA, 20 bp, Artificial Sequence
  Synthetic Construct
gacaggcacttggcgatcat

SEQ ID NO: 37162 - DNA, 22 bp, Artificial Sequence
  Synthetic Construct
ggacttccccataccaggatct

SEQ ID NO: 37163 - DNA, 23 bp, Artificial Sequence
  Synthetic Construct
ccaatgatggcgctcagcttttt

SEQ ID NO: 37164 - DNA, 22 bp, Artificial Sequence
  Synthetic Construct
caggccaagctctttccacttc

SEQ ID NO: 37165 - DNA, 26 bp, Artificial Sequence
  Synthetic Construct
gggtctgtaagattttccccagaagt

SEQ ID NO: 37166 - DNA, 24 bp, Artificial Sequence
  Synthetic Construct
ctgagctaggattcaaggcagcta

SEQ ID NO: 37167 - DNA, 21 bp, Artificial Sequence
  Synthetic Construct
acctggactgagtctcacctt

SEQ ID NO: 37168 - DNA, 20 bp, Artificial Sequence
  Synthetic Construct
aagaccacccagaccacaga

SEQ ID NO: 37169 - DNA, 24 bp, Artificial Sequence
  Synthetic Construct
gtggcaggttgaatgcagtagttg

SEQ ID NO: 37170 - DNA, 21 bp, Artificial Sequence
  Synthetic Construct
cacagctgctgctttgaggaa

SEQ ID NO: 37171 - DNA, 22 bp, Artificial Sequence
  Synthetic Construct
ggggtgtgtagaacctgtggaa

SEQ ID NO: 37172 - DNA, 24 bp, Artificial Sequence
  Synthetic Construct
ggcctctaagaacccaatctgtct

SEQ ID NO: 37173 - DNA, 24 bp, Artificial Sequence
  Synthetic Construct
ccatcagagagtggaggtcacaag

SEQ ID NO: 37174 - DNA, 20 bp, Artificial Sequence
  Synthetic Construct
acccaggaaccgttcagttg

SEQ ID NO: 37175 - DNA, 27 bp, Artificial Sequence
  Synthetic Construct
gaggataatgcctcatcccttatttca

SEQ ID NO: 37176 - DNA, 20 bp, Artificial Sequence
  Synthetic Construct
ggtagaagggtgcccactca

SEQ ID NO: 37177 - DNA, 20 bp, Artificial Sequence
  Synthetic Construct
ctgtggaggctttggagcaa

SEQ ID NO: 37178 - DNA, 20 bp, Artificial Sequence
  Synthetic Construct
cctggccgatcccactttga

SEQ ID NO: 37179 - DNA, 22 bp, Artificial Sequence
  Synthetic Construct
tgggcctatcctggttgtctct

SEQ ID NO: 37180 - DNA, 24 bp, Artificial Sequence
  Synthetic Construct
gaagtggcaaggacagttagaagt

SEQ ID NO: 37181 - DNA, 24 bp, Artificial Sequence
  Synthetic Construct
gtgacagtctttggctacctccaa

SEQ ID NO: 37182 - DNA, 22 bp, Artificial Sequence
  Synthetic Construct
gacctagtgccttcagtgaaca

SEQ ID NO: 37183 - DNA, 22 bp, Artificial Sequence
  Synthetic Construct
gggaagtggatcaggtttccat

SEQ ID NO: 37184 - DNA, 23 bp, Artificial Sequence
  Synthetic Construct
ggaacagcagatcagagaaggtt

SEQ ID NO: 37185 - DNA, 20 bp, Artificial Sequence
  Synthetic Construct
agtgcttggccctacagttg

SEQ ID NO: 37186 - DNA, 24 bp, Artificial Sequence
  Synthetic Construct
cctgcatctttgagggtagccaaa

SEQ ID NO: 37187 - DNA, 24 bp, Artificial Sequence
  Synthetic Construct
tcctttgctgtttccctttcatct

SEQ ID NO: 37188 - DNA, 22 bp, Artificial Sequence
  Synthetic Construct
gagcagggatctcaggctcttt

SEQ ID NO: 37189 - DNA, 22 bp, Artificial Sequence
  Synthetic Construct
gcctcactgagcccaagtttct

SEQ ID NO: 37190 - DNA, 18 bp, Artificial Sequence
  Synthetic Construct
agtgccagggccatcagt

SEQ ID NO: 37191 - DNA, 21 bp, Artificial Sequence
  Synthetic Construct
agccctggatctccactgttg

SEQ ID NO: 37192 - DNA, 25 bp, Artificial Sequence
  Synthetic Construct
attgctatcacataggtggttctgt

SEQ ID NO: 37193 - DNA, 29 bp, Artificial Sequence
  Synthetic Construct
ctctcagttagtgattaaggggtactttc

SEQ ID NO: 37194 - DNA, 22 bp, Artificial Sequence
  Synthetic Construct
agtacctggggacttgactgaa

SEQ ID NO: 37195 - DNA, 19 bp, Artificial Sequence
  Synthetic Construct
aggttgccaggccctgagt

SEQ ID NO: 37196 - DNA, 22 bp, Artificial Sequence
  Synthetic Construct
ctcacccaaggcttgctgtaac

SEQ ID NO: 37197 - DNA, 25 bp, Artificial Sequence
  Synthetic Construct
gaaggaatttagagggactgcagaa

SEQ ID NO: 37198 - DNA, 26 bp, Artificial Sequence
  Synthetic Construct
cacagtcttccatctctcacttctca

SEQ ID NO: 37199 - DNA, 23 bp, Artificial Sequence
  Synthetic Construct
cagaaaagcaaggcatcctggaa

SEQ ID NO: 37200 - DNA, 24 bp, Artificial Sequence
  Synthetic Construct
gtcagaaagaaggccagtgtgtca

SEQ ID NO: 37201 - DNA, 24 bp, Artificial Sequence
  Synthetic Construct
gcttcccattgcctacgaggtaca

SEQ ID NO: 37202 - DNA, 23 bp, Artificial Sequence
  Synthetic Construct
ctcgccaggaatttagcctcttc

SEQ ID NO: 37203 - DNA, 22 bp, Artificial Sequence
  Synthetic Construct
gtggctgctcttgggctacagt

SEQ ID NO: 37204 - DNA, 29 bp, Artificial Sequence
  Synthetic Construct
gcggaatttctcattccatttgaggaaag

SEQ ID NO: 37205 - DNA, 23 bp, Artificial Sequence
  Synthetic Construct
gaccaagttcttggggtggaaga

SEQ ID NO: 37206 - DNA, 22 bp, Artificial Sequence
  Synthetic Construct
ctttgtgtctaccacggtccat

SEQ ID NO: 37207 - DNA, 25 bp, Artificial Sequence
  Synthetic Construct
tcatgtgtaccagaagcatctgaag

SEQ ID NO: 37208 - DNA, 21 bp, Artificial Sequence
  Synthetic Construct
ttactcagcgggccagggaaa

SEQ ID NO: 37209 - DNA, 20 bp, Artificial Sequence
  Synthetic Construct
gagggtggcaccatgtttgt

SEQ ID NO: 37210 - DNA, 19 bp, Artificial Sequence
  Synthetic Construct
tcgcacacctcacccagat

SEQ ID NO: 37211 - DNA, 22 bp, Artificial Sequence
  Synthetic Construct
gggatccacaggtggttcagat

SEQ ID NO: 37212 - DNA, 25 bp, Artificial Sequence
  Synthetic Construct
tcctataaatcctgggatggaggaa

SEQ ID NO: 37213 - DNA, 20 bp, Artificial Sequence
  Synthetic Construct
gcccacacaaggtcagcatt

SEQ ID NO: 37214 - DNA, 22 bp, Artificial Sequence
  Synthetic Construct
ccactcaccacttcagggatca

SEQ ID NO: 37215 - DNA, 23 bp, Artificial Sequence
  Synthetic Construct
ggagctctcatcctggataggta

SEQ ID NO: 37216 - DNA, 23 bp, Artificial Sequence
  Synthetic Construct
cctctccttacgttggcttgaac

SEQ ID NO: 37217 - DNA, 20 bp, Artificial Sequence
  Synthetic Construct
atctgggcagagccagaagt

SEQ ID NO: 37218 - DNA, 22 bp, Artificial Sequence
  Synthetic Construct
aggcagtgtcccaaagctgttc

SEQ ID NO: 37219 - DNA, 25 bp, Artificial Sequence
  Synthetic Construct
ggacctagacactgaatgcttcttg

SEQ ID NO: 37220 - DNA, 20 bp, Artificial Sequence
  Synthetic Construct
tggtccttgctgccttcttc

SEQ ID NO: 37221 - DNA, 22 bp, Artificial Sequence
  Synthetic Construct
gggtttttcgcgactggggatt

SEQ ID NO: 37222 - DNA, 21 bp, Artificial Sequence
  Synthetic Construct
actgtgctgatccctccctta

SEQ ID NO: 37223 - DNA, 24 bp, Artificial Sequence
  Synthetic Construct
caattggacttgtgttgcctcaaa

SEQ ID NO: 37224 - DNA, 22 bp, Artificial Sequence
  Synthetic Construct
ccgcctttccctgaggttcatt

SEQ ID NO: 37225 - DNA, 23 bp, Artificial Sequence
  Synthetic Construct
tgaaagaggtcctggtgacaaac

SEQ ID NO: 37226 - DNA, 26 bp, Artificial Sequence
  Synthetic Construct
cagtgttcaattcaagcacgtacatc

SEQ ID NO: 37227 - DNA, 25 bp, Artificial Sequence
  Synthetic Construct
ccatgcaaactgctaatccttccaa

SEQ ID NO: 37228 - DNA, 22 bp, Artificial Sequence
  Synthetic Construct
ccaggacaaccacgcgtctaaa

SEQ ID NO: 37229 - DNA, 20 bp, Artificial Sequence
  Synthetic Construct
gccaaaagctgagggtggaa

SEQ ID NO: 37230 - DNA, 24 bp, Artificial Sequence
  Synthetic Construct
ggatccaacttttcccatgctaga

SEQ ID NO: 37231 - DNA, 23 bp, Artificial Sequence
  Synthetic Construct
gatcaacctgcattgtcctgtca

SEQ ID NO: 37232 - DNA, 19 bp, Artificial Sequence
  Synthetic Construct
tctttcccgggcacagaac

SEQ ID NO: 37233 - DNA, 25 bp, Artificial Sequence
  Synthetic Construct
gggaattgtctcttgactccaaaac

SEQ ID NO: 37234 - DNA, 19 bp, Artificial Sequence
  Synthetic Construct
tggctgcccaccccaagta

SEQ ID NO: 37235 - DNA, 22 bp, Artificial Sequence
  Synthetic Construct
tgaagcactagagcaggagtct

SEQ ID NO: 37236 - DNA, 19 bp, Artificial Sequence
  Synthetic Construct
gcaaaggggacaggcgaaa

SEQ ID NO: 37237 - DNA, 28 bp, Artificial Sequence
  Synthetic Construct
gcacttttctattggttggtgggcttag

SEQ ID NO: 37238 - DNA, 22 bp, Artificial Sequence
  Synthetic Construct
cgccgggcctacacatcttaaa

SEQ ID NO: 37239 - DNA, 22 bp, Artificial Sequence
  Synthetic Construct
ggagggtgattctgggaagatg

SEQ ID NO: 37240 - DNA, 26 bp, Artificial Sequence
  Synthetic Construct
caaaacccagattctttcctcacaga

SEQ ID NO: 37241 - DNA, 26 bp, Artificial Sequence
  Synthetic Construct
gggaaggttagaccaaatgatgatga

SEQ ID NO: 37242 - DNA, 24 bp, Artificial Sequence
  Synthetic Construct
cgatcctctaggcttgagttctct

SEQ ID NO: 37243 - DNA, 25 bp, Artificial Sequence
  Synthetic Construct
ccccgttggtatgatgagaaactgt

SEQ ID NO: 37244 - DNA, 21 bp, Artificial Sequence
  Synthetic Construct
ggtgcagggctttctgaatgt

SEQ ID NO: 37245 - DNA, 26 bp, Artificial Sequence
  Synthetic Construct
gcatttctatgtccatgcacgatttc

SEQ ID NO: 37246 - DNA, 24 bp, Artificial Sequence
  Synthetic Construct
gcctttgtcaatgggtggcaatag

SEQ ID NO: 37247 - DNA, 19 bp, Artificial Sequence
  Synthetic Construct
tgtggggccgcaatgatag

SEQ ID NO: 37248 - DNA, 23 bp, Artificial Sequence
  Synthetic Construct
ccggacaaagccactgatgaaga

SEQ ID NO: 37249 - DNA, 22 bp, Artificial Sequence
  Synthetic Construct
gtatgctccagtcgaggtcttg

SEQ ID NO: 37250 - DNA, 22 bp, Artificial Sequence
  Synthetic Construct
ccctggaccgcacttgaagtat

SEQ ID NO: 37251 - DNA, 24 bp, Artificial Sequence
  Synthetic Construct
atttccctaggatacagggcattg

SEQ ID NO: 37252 - DNA, 23 bp, Artificial Sequence
  Synthetic Construct
cctgaaatgtgggctgacacagt

SEQ ID NO: 37253 - DNA, 22 bp, Artificial Sequence
  Synthetic Construct
aagggctctcaggttccagttg

SEQ ID NO: 37254 - DNA, 23 bp, Artificial Sequence
  Synthetic Construct
ccccacagagccatgtgaagaag

SEQ ID NO: 37255 - DNA, 26 bp, Artificial Sequence
  Synthetic Construct
tgaataaattcccttccccaggaaac

SEQ ID NO: 37256 - DNA, 22 bp, Artificial Sequence
  Synthetic Construct
ggtggagaagtggagtgtgact

SEQ ID NO: 37257 - DNA, 24 bp, Artificial Sequence
  Synthetic Construct
gctctaggctacaggttccatatc

SEQ ID NO: 37258 - DNA, 24 bp, Artificial Sequence
  Synthetic Construct
ggggtggaaacgtgagacaaggaa

SEQ ID NO: 37259 - DNA, 27 bp, Artificial Sequence
  Synthetic Construct
gagccataaagatagctcaagctggta

SEQ ID NO: 37260 - DNA, 22 bp, Artificial Sequence
  Synthetic Construct
ggcatcctgcagaagggaagtt

SEQ ID NO: 37261 - DNA, 22 bp, Artificial Sequence
  Synthetic Construct
gccatgactccccattgggtta

SEQ ID NO: 37262 - DNA, 20 bp, Artificial Sequence
  Synthetic Construct
agggccctgtctcttgaact

SEQ ID NO: 37263 - DNA, 21 bp, Artificial Sequence
  Synthetic Construct
atgtgggagccgtccagttct

SEQ ID NO: 37264 - DNA, 22 bp, Artificial Sequence
  Synthetic Construct
caggatcactactgggccacaa

SEQ ID NO: 37265 - DNA, 24 bp, Artificial Sequence
  Synthetic Construct
atttgacttacagtgcggctaatg

SEQ ID NO: 37266 - DNA, 25 bp, Artificial Sequence
  Synthetic Construct
ctttctggatgtctgggtttcaact

SEQ ID NO: 37267 - DNA, 22 bp, Artificial Sequence
  Synthetic Construct
caggagtgggtgtctgatggaa

SEQ ID NO: 37268 - DNA, 25 bp, Artificial Sequence
  Synthetic Construct
ggaatatagggcacatccgtgtaag

SEQ ID NO: 37269 - DNA, 22 bp, Artificial Sequence
  Synthetic Construct
ctgggttgagcttggggttaga

SEQ ID NO: 37270 - DNA, 22 bp, Artificial Sequence
  Synthetic Construct
gatagcgtgcaccatgcataac

SEQ ID NO: 37271 - DNA, 20 bp, Artificial Sequence
  Synthetic Construct
cactcattgccctccactgt

SEQ ID NO: 37272 - DNA, 24 bp, Artificial Sequence
  Synthetic Construct
cagccctattggtcaaggcctatt

SEQ ID NO: 37273 - DNA, 27 bp, Artificial Sequence
  Synthetic Construct
cctgccatcctacctgaatcattctca

SEQ ID NO: 37274 - DNA, 21 bp, Artificial Sequence
  Synthetic Construct
tggtgactcagtggcctcctt

SEQ ID NO: 37275 - DNA, 24 bp, Artificial Sequence
  Synthetic Construct
gcggcaactaagctcaattaggaa

SEQ ID NO: 37276 - DNA, 21 bp, Artificial Sequence
  Synthetic Construct
tcatggtgtttgcggtgaaac

SEQ ID NO: 37277 - DNA, 22 bp, Artificial Sequence
  Synthetic Construct
gcctgaggtcacatcccaccta

SEQ ID NO: 37278 - DNA, 21 bp, Artificial Sequence
  Synthetic Construct
ccagagcccttcagcaagaaa

SEQ ID NO: 37279 - DNA, 22 bp, Artificial Sequence
  Synthetic Construct
ccgcagcatcaaagagttgcat

SEQ ID NO: 37280 - DNA, 22 bp, Artificial Sequence
  Synthetic Construct
cacacacggcttgtggaaatag

SEQ ID NO: 37281 - DNA, 21 bp, Artificial Sequence
  Synthetic Construct
tgtgcacttcctggctcattt

SEQ ID NO: 37282 - DNA, 22 bp, Artificial Sequence
  Synthetic Construct
agctgtctggccctgaagaaag

SEQ ID NO: 37283 - DNA, 20 bp, Artificial Sequence
  Synthetic Construct
actggggaagcaggactaca

SEQ ID NO: 37284 - DNA, 26 bp, Artificial Sequence
  Synthetic Construct
gcttgaagaagctcttggtgatgatg

SEQ ID NO: 37285 - DNA, 24 bp, Artificial Sequence
  Synthetic Construct
catcccactggtacagtcaagttc

SEQ ID NO: 37286 - DNA, 24 bp, Artificial Sequence
  Synthetic Construct
gggtagaactccacgtgctagatg

SEQ ID NO: 37287 - DNA, 19 bp, Artificial Sequence
  Synthetic Construct
acaggggtgggcttgctta

SEQ ID NO: 37288 - DNA, 19 bp, Artificial Sequence
  Synthetic Construct
tgctggaggtgccagcata

SEQ ID NO: 37289 - DNA, 25 bp, Artificial Sequence
  Synthetic Construct
ctgaccataggacagaaaccctgta

SEQ ID NO: 37290 - DNA, 22 bp, Artificial Sequence
  Synthetic Construct
gcatggcatagtggggacattg

SEQ ID NO: 37291 - DNA, 23 bp, Artificial Sequence
  Synthetic Construct
ggactggctcaaagcagcttaac

SEQ ID NO: 37292 - DNA, 25 bp, Artificial Sequence
  Synthetic Construct
tcaagtgagactgatgctggtaatc

SEQ ID NO: 37293 - DNA, 19 bp, Artificial Sequence
  Synthetic Construct
agctggcaagcctcgtaga

SEQ ID NO: 37294 - DNA, 21 bp, Artificial Sequence
  Synthetic Construct
ataagcggaggccctgacttc

SEQ ID NO: 37295 - DNA, 24 bp, Artificial Sequence
  Synthetic Construct
gctgggacgtacctaagtggatga

SEQ ID NO: 37296 - DNA, 22 bp, Artificial Sequence
  Synthetic Construct
acccaccctatacaccgcattc

SEQ ID NO: 37297 - DNA, 20 bp, Artificial Sequence
  Synthetic Construct
tctggctcccggtaacatct

SEQ ID NO: 37298 - DNA, 21 bp, Artificial Sequence
  Synthetic Construct
aaaccaggcctgcactttttc

SEQ ID NO: 37299 - DNA, 21 bp, Artificial Sequence
  Synthetic Construct
acctgtagccagggtgaggat

SEQ ID NO: 37300 - DNA, 23 bp, Artificial Sequence
  Synthetic Construct
ggaggataactgccactgtgctt

SEQ ID NO: 37301 - DNA, 20 bp, Artificial Sequence
  Synthetic Construct
cttgcccctttgcaccacta

SEQ ID NO: 37302 - DNA, 20 bp, Artificial Sequence
  Synthetic Construct
agccccaaactccccagaaa

SEQ ID NO: 37303 - DNA, 20 bp, Artificial Sequence
  Synthetic Construct
aaggcaagggaaaggtgcaa

SEQ ID NO: 37304 - DNA, 21 bp, Artificial Sequence
  Synthetic Construct
gcctgaccttgggctttgtct

SEQ ID NO: 37305 - DNA, 20 bp, Artificial Sequence
  Synthetic Construct
tggagcagctgccagttaga

SEQ ID NO: 37306 - DNA, 23 bp, Artificial Sequence
  Synthetic Construct
gggaacagaggatcccactgaag

SEQ ID NO: 37307 - DNA, 24 bp, Artificial Sequence
  Synthetic Construct
ccagttcccagggtagaatcatct

SEQ ID NO: 37308 - DNA, 22 bp, Artificial Sequence
  Synthetic Construct
agtagccctgaatggcctgaag

SEQ ID NO: 37309 - DNA, 24 bp, Artificial Sequence
  Synthetic Construct
ccaggagctgaagacactaagatg

SEQ ID NO: 37310 - DNA, 24 bp, Artificial Sequence
  Synthetic Construct
ggtgagacactggggatagcacaa

SEQ ID NO: 37311 - DNA, 24 bp, Artificial Sequence
  Synthetic Construct
ggtgcctgttagatagtggtgcta

SEQ ID NO: 37312 - DNA, 26 bp, Artificial Sequence
  Synthetic Construct
ccttggctgtgattacaagaccacat

SEQ ID NO: 37313 - DNA, 22 bp, Artificial Sequence
  Synthetic Construct
ggcagggcttggccttaaagat

SEQ ID NO: 37314 - DNA, 25 bp, Artificial Sequence
  Synthetic Construct
agctgtcttagtcaataagcgtgaa

SEQ ID NO: 37315 - DNA, 19 bp, Artificial Sequence
  Synthetic Construct
tggaaggcccctgctgttc

SEQ ID NO: 37316 - DNA, 26 bp, Artificial Sequence
  Synthetic Construct
gctgaaatgaagtgactctacctcta

SEQ ID NO: 37317 - DNA, 22 bp, Artificial Sequence
  Synthetic Construct
agcttttccctgcttctcacaa

SEQ ID NO: 37318 - DNA, 23 bp, Artificial Sequence
  Synthetic Construct
tccaatcaataggttgccagtgt

SEQ ID NO: 37319 - DNA, 24 bp, Artificial Sequence
  Synthetic Construct
ggaaagacaactccttggccattc

SEQ ID NO: 37320 - DNA, 25 bp, Artificial Sequence
  Synthetic Construct
gtgggagtacagtgaaaggttgaag

SEQ ID NO: 37321 - DNA, 22 bp, Artificial Sequence
  Synthetic Construct
ggagaccagatggcgggaaaaa

SEQ ID NO: 37322 - DNA, 26 bp, Artificial Sequence
  Synthetic Construct
ccttactcctgagaagtgcttctttc

SEQ ID NO: 37323 - DNA, 23 bp, Artificial Sequence
  Synthetic Construct
agtgttgcgagctgacaatttac

SEQ ID NO: 37324 - DNA, 25 bp, Artificial Sequence
  Synthetic Construct
gcaggcctgactaaattctcaacta

SEQ ID NO: 37325 - DNA, 22 bp, Artificial Sequence
  Synthetic Construct
tccaacagtgggttacctctca

SEQ ID NO: 37326 - DNA, 24 bp, Artificial Sequence
  Synthetic Construct
ccaggttcaacactctggatctgt

SEQ ID NO: 37327 - DNA, 24 bp, Artificial Sequence
  Synthetic Construct
cattaacattagcgccctggaaac

SEQ ID NO: 37328 - DNA, 24 bp, Artificial Sequence
  Synthetic Construct
cggcctgtcacacacatcagatag

SEQ ID NO: 37329 - DNA, 20 bp, Artificial Sequence
  Synthetic Construct
acacaaggttggggcaggat

SEQ ID NO: 37330 - DNA, 26 bp, Artificial Sequence
  Synthetic Construct
ggtctgggagaattaggagtagtaga

SEQ ID NO: 37331 - DNA, 23 bp, Artificial Sequence
  Synthetic Construct
gctgtttcgcagccatcactgtt

SEQ ID NO: 37332 - DNA, 19 bp, Artificial Sequence
  Synthetic Construct
aaggagggtgcggggtctt

SEQ ID NO: 37333 - DNA, 18 bp, Artificial Sequence
  Synthetic Construct
cagccgtcagcggcaaaa

SEQ ID NO: 37334 - DNA, 19 bp, Artificial Sequence
  Synthetic Construct
tgccttgctgggcctcgaa

SEQ ID NO: 37335 - DNA, 24 bp, Artificial Sequence
  Synthetic Construct
acccctttctagggagaagctatg

SEQ ID NO: 37336 - DNA, 24 bp, Artificial Sequence
  Synthetic Construct
tccattctttccccactgatttga

SEQ ID NO: 37337 - DNA, 23 bp, Artificial Sequence
  Synthetic Construct
cacagacaggatctggcaactac

SEQ ID NO: 37338 - DNA, 26 bp, Artificial Sequence
  Synthetic Construct
gtcattgccttacagtgaaaccttct

SEQ ID NO: 37339 - DNA, 24 bp, Artificial Sequence
  Synthetic Construct
gccccttacaccactttccacctt

SEQ ID NO: 37340 - DNA, 22 bp, Artificial Sequence
  Synthetic Construct
ggtgattggtggttgcactcta

SEQ ID NO: 37341 - DNA, 20 bp, Artificial Sequence
  Synthetic Construct
gcgatacgtaggcggagctt

SEQ ID NO: 37342 - DNA, 20 bp, Artificial Sequence
  Synthetic Construct
tggggtgcttctctctggat

SEQ ID NO: 37343 - DNA, 26 bp, Artificial Sequence
  Synthetic Construct
gagaggaaactggtgacaatacagat

SEQ ID NO: 37344 - DNA, 23 bp, Artificial Sequence
  Synthetic Construct
gggtggatccctccaggatgtaa

SEQ ID NO: 37345 - DNA, 20 bp, Artificial Sequence
  Synthetic Construct
tccggctacgccagtcaaaa

SEQ ID NO: 37346 - DNA, 19 bp, Artificial Sequence
  Synthetic Construct
acccgtggcaacccctttc

SEQ ID NO: 37347 - DNA, 19 bp, Artificial Sequence
  Synthetic Construct
ttgccctggtcgctgtagt

SEQ ID NO: 37348 - DNA, 21 bp, Artificial Sequence
  Synthetic Construct
aaggggacttggcccacagat

SEQ ID NO: 37349 - DNA, 20 bp, Artificial Sequence
  Synthetic Construct
cctgtgaccaccctgcttct

SEQ ID NO: 37350 - DNA, 20 bp, Artificial Sequence
  Synthetic Construct
tgtgccggctctcctcttct

SEQ ID NO: 37351 - DNA, 22 bp, Artificial Sequence
  Synthetic Construct
ccttcctaccactgaccccaat

SEQ ID NO: 37352 - DNA, 20 bp, Artificial Sequence
  Synthetic Construct
ctcctggagcgtctgcaaaa

SEQ ID NO: 37353 - DNA, 24 bp, Artificial Sequence
  Synthetic Construct
tgaacctttttgggtgaaggtagt

SEQ ID NO: 37354 - DNA, 23 bp, Artificial Sequence
  Synthetic Construct
gtgcagaataggcaaggagaact

SEQ ID NO: 37355 - DNA, 26 bp, Artificial Sequence
  Synthetic Construct
ggagaacttcacccatgtcccacatt

SEQ ID NO: 37356 - DNA, 24 bp, Artificial Sequence
  Synthetic Construct
gggctccaatcaaggaattgaaca

SEQ ID NO: 37357 - DNA, 23 bp, Artificial Sequence
  Synthetic Construct
gacaggttggcctgagtttcaga

SEQ ID NO: 37358 - DNA, 26 bp, Artificial Sequence
  Synthetic Construct
gtccctgtcatttacacgtgttctct

SEQ ID NO: 37359 - DNA, 20 bp, Artificial Sequence
  Synthetic Construct
cctgtgttggccgactttga

SEQ ID NO: 37360 - DNA, 22 bp, Artificial Sequence
  Synthetic Construct
ctggaaacagaccctgctcaca

SEQ ID NO: 37361 - DNA, 23 bp, Artificial Sequence
  Synthetic Construct
tttctctccgctctctccttttc

SEQ ID NO: 37362 - DNA, 19 bp, Artificial Sequence
  Synthetic Construct
ccaccgtccgcatcagctt

SEQ ID NO: 37363 - DNA, 22 bp, Artificial Sequence
  Synthetic Construct
gggaagaagggtgaaggccaat

SEQ ID NO: 37364 - DNA, 22 bp, Artificial Sequence
  Synthetic Construct
gggagggtgccattcattccat

SEQ ID NO: 37365 - DNA, 25 bp, Artificial Sequence
  Synthetic Construct
ggagagggaggaagatggagttttc

SEQ ID NO: 37366 - DNA, 22 bp, Artificial Sequence
  Synthetic Construct
ctggtacggcattggtctctga

SEQ ID NO: 37367 - DNA, 24 bp, Artificial Sequence
  Synthetic Construct
ggtaatcgacagcaacatgctaca

SEQ ID NO: 37368 - DNA, 21 bp, Artificial Sequence
  Synthetic Construct
ggcggcaccgcattcttatag

SEQ ID NO: 37369 - DNA, 22 bp, Artificial Sequence
  Synthetic Construct
tttggggaaggaaggccctaag

SEQ ID NO: 37370 - DNA, 23 bp, Artificial Sequence
  Synthetic Construct
caggaatttcgcgaaggggtttc

SEQ ID NO: 37371 - DNA, 24 bp, Artificial Sequence
  Synthetic Construct
gctacagaagggaagtgactgttc

SEQ ID NO: 37372 - DNA, 24 bp, Artificial Sequence
  Synthetic Construct
ccatttaagagccaactcctggaa

SEQ ID NO: 37373 - DNA, 24 bp, Artificial Sequence
  Synthetic Construct
ttccttcacctcattgcatacaga

SEQ ID NO: 37374 - DNA, 21 bp, Artificial Sequence
  Synthetic Construct
tgctttaccctcagccagtga

SEQ ID NO: 37375 - DNA, 20 bp, Artificial Sequence
  Synthetic Construct
tgcagactggggctgattct

SEQ ID NO: 37376 - DNA, 20 bp, Artificial Sequence
  Synthetic Construct
tcccaagactctggcagaca

SEQ ID NO: 37377 - DNA, 22 bp, Artificial Sequence
  Synthetic Construct
ccctcaggcctgtcatcctagt

SEQ ID NO: 37378 - DNA, 21 bp, Artificial Sequence
  Synthetic Construct
ggggcttaaggagcccaatgt

SEQ ID NO: 37379 - DNA, 20 bp, Artificial Sequence
  Synthetic Construct
accatgcctgccccattgat

SEQ ID NO: 37380 - DNA, 26 bp, Artificial Sequence
  Synthetic Construct
gggtaaatgctactgcagtgcctaag

SEQ ID NO: 37381 - DNA, 27 bp, Artificial Sequence
  Synthetic Construct
gaggttactgtttgctttgcattgact

SEQ ID NO: 37382 - DNA, 20 bp, Artificial Sequence
  Synthetic Construct
ttcctgttcctccgcctaca

SEQ ID NO: 37383 - DNA, 20 bp, Artificial Sequence
  Synthetic Construct
gcctccatggttgcaccaaa

SEQ ID NO: 37384 - DNA, 26 bp, Artificial Sequence
  Synthetic Construct
gccatgataaggaatctcgggtgaag

SEQ ID NO: 37385 - DNA, 20 bp, Artificial Sequence
  Synthetic Construct
atcctcgcgatggcagtagt

SEQ ID NO: 37386 - DNA, 24 bp, Artificial Sequence
  Synthetic Construct
ggagtgcagaggaaggactttatg

SEQ ID NO: 37387 - DNA, 21 bp, Artificial Sequence
  Synthetic Construct
gaacttgggccactagcttca

SEQ ID NO: 37388 - DNA, 21 bp, Artificial Sequence
  Synthetic Construct
ttctcctagaccgccagctaa

SEQ ID NO: 37389 - DNA, 21 bp, Artificial Sequence
  Synthetic Construct
ccagctctccaagacgctgaa

SEQ ID NO: 37390 - DNA, 20 bp, Artificial Sequence
  Synthetic Construct
tcttgccctggtcccacagt

SEQ ID NO: 37391 - DNA, 22 bp, Artificial Sequence
  Synthetic Construct
ggtggtagaaaggcgtgtggaa

SEQ ID NO: 37392 - DNA, 20 bp, Artificial Sequence
  Synthetic Construct
atcggtttcctgggctgttg

SEQ ID NO: 37393 - DNA, 20 bp, Artificial Sequence
  Synthetic Construct
tccacttgtgaccccagaca

SEQ ID NO: 37394 - DNA, 25 bp, Artificial Sequence
  Synthetic Construct
gtgcaacttttctccatgaacttgt

SEQ ID NO: 37395 - DNA, 21 bp, Artificial Sequence
  Synthetic Construct
gcctagtacatgtggggcttt

SEQ ID NO: 37396 - DNA, 23 bp, Artificial Sequence
  Synthetic Construct
gtcatgggatggagccatgatct

SEQ ID NO: 37397 - DNA, 21 bp, Artificial Sequence
  Synthetic Construct
ggttgtgccagcagcaaacta

SEQ ID NO: 37398 - DNA, 22 bp, Artificial Sequence
  Synthetic Construct
ggtgccatgttttctccctgaa

SEQ ID NO: 37399 - DNA, 20 bp, Artificial Sequence
  Synthetic Construct
gctccctgctttaggcacat

SEQ ID NO: 37400 - DNA, 25 bp, Artificial Sequence
  Synthetic Construct
cccatctgccttcactaagggcttt

SEQ ID NO: 37401 - DNA, 21 bp, Artificial Sequence
  Synthetic Construct
cactgagcaggctgatgtttg

SEQ ID NO: 37402 - DNA, 25 bp, Artificial Sequence
  Synthetic Construct
gcatgggtttttgaggcacagattc

SEQ ID NO: 37403 - DNA, 21 bp, Artificial Sequence
  Synthetic Construct
tgcactgctccgtacctggat

SEQ ID NO: 37404 - DNA, 22 bp, Artificial Sequence
  Synthetic Construct
acaccaaggcttccttgtgcta

SEQ ID NO: 37405 - DNA, 20 bp, Artificial Sequence
  Synthetic Construct
ttcccagcctcccttgtagt

SEQ ID NO: 37406 - DNA, 23 bp, Artificial Sequence
  Synthetic Construct
ggctcctgttttagtccccagat

SEQ ID NO: 37407 - DNA, 23 bp, Artificial Sequence
  Synthetic Construct
ggccaatatgacagctagcctaa

SEQ ID NO: 37408 - DNA, 24 bp, Artificial Sequence
  Synthetic Construct
gagaaggggataggagacctgaac

SEQ ID NO: 37409 - DNA, 24 bp, Artificial Sequence
  Synthetic Construct
cagggtatcaaactgtagctgtgt

SEQ ID NO: 37410 - DNA, 24 bp, Artificial Sequence
  Synthetic Construct
ccacaaagtgctctttccccacaa

SEQ ID NO: 37411 - DNA, 23 bp, Artificial Sequence
  Synthetic Construct
gcatagcaccctgtccagactat

SEQ ID NO: 37412 - DNA, 22 bp, Artificial Sequence
  Synthetic Construct
gcctcatctgcagtttggtaca

SEQ ID NO: 37413 - DNA, 20 bp, Artificial Sequence
  Synthetic Construct
tcaggcctgcaaggatctgt

SEQ ID NO: 37414 - DNA, 20 bp, Artificial Sequence
  Synthetic Construct
cattcaggcactggctgtga

SEQ ID NO: 37415 - DNA, 24 bp, Artificial Sequence
  Synthetic Construct
ggcagaactgaaacatgcttcttc

SEQ ID NO: 37416 - DNA, 24 bp, Artificial Sequence
  Synthetic Construct
tgttggttaatgcactctgtgttg

SEQ ID NO: 37417 - DNA, 20 bp, Artificial Sequence
  Synthetic Construct
ggttttgtgggccccattct

SEQ ID NO: 37418 - DNA, 23 bp, Artificial Sequence
  Synthetic Construct
ggttgtcgctgcttctacaaatc

SEQ ID NO: 37419 - DNA, 24 bp, Artificial Sequence
  Synthetic Construct
ggacttgggagaagcaaagtgttc

SEQ ID NO: 37420 - DNA, 26 bp, Artificial Sequence
  Synthetic Construct
cctagcctaaaataaccatgcacttg

SEQ ID NO: 37421 - DNA, 25 bp, Artificial Sequence
  Synthetic Construct
cctgggccaatagttagaagtggtt

SEQ ID NO: 37422 - DNA, 20 bp, Artificial Sequence
  Synthetic Construct
taggggtgcctgcagtttct

SEQ ID NO: 37423 - DNA, 21 bp, Artificial Sequence
  Synthetic Construct
ggcctttcctcatgcttccaa

SEQ ID NO: 37424 - DNA, 25 bp, Artificial Sequence
  Synthetic Construct
ccccaggaaatctacacttctctca

SEQ ID NO: 37425 - DNA, 20 bp, Artificial Sequence
  Synthetic Construct
ccttgtgaggccagggagtt

SEQ ID NO: 37426 - DNA, 20 bp, Artificial Sequence
  Synthetic Construct
agtgccagcaggggcagact

SEQ ID NO: 37427 - DNA, 23 bp, Artificial Sequence
  Synthetic Construct
cactacattgtccgttcccattg

SEQ ID NO: 37428 - DNA, 21 bp, Artificial Sequence
  Synthetic Construct
ggtgtgtggatgggttagctt

SEQ ID NO: 37429 - DNA, 21 bp, Artificial Sequence
  Synthetic Construct
gctcaaaccacctttgcaact

SEQ ID NO: 37430 - DNA, 25 bp, Artificial Sequence
  Synthetic Construct
agaaggacttcacaatgccattaca

SEQ ID NO: 37431 - DNA, 25 bp, Artificial Sequence
  Synthetic Construct
ggtagcagaatatgggtccctgtct

SEQ ID NO: 37432 - DNA, 22 bp, Artificial Sequence
  Synthetic Construct
cgaaacccaccttcaagcctaa

SEQ ID NO: 37433 - DNA, 20 bp, Artificial Sequence
  Synthetic Construct
tcctttccacagcgcgtcaa

SEQ ID NO: 37434 - DNA, 24 bp, Artificial Sequence
  Synthetic Construct
gtcttgtaccctcttaccatgctt

SEQ ID NO: 37435 - DNA, 19 bp, Artificial Sequence
  Synthetic Construct
tgcgtctggccgtgtgagt

SEQ ID NO: 37436 - DNA, 21 bp, Artificial Sequence
  Synthetic Construct
aagggccgtccttgggagtta

SEQ ID NO: 37437 - DNA, 21 bp, Artificial Sequence
  Synthetic Construct
tagctgggaccacaggtgcat

SEQ ID NO: 37438 - DNA, 24 bp, Artificial Sequence
  Synthetic Construct
cctctcttgtgtcagcacccaatc

SEQ ID NO: 37439 - DNA, 22 bp, Artificial Sequence
  Synthetic Construct
tccctgagggtaggcctctgaa

SEQ ID NO: 37440 - DNA, 22 bp, Artificial Sequence
  Synthetic Construct
aagtgtgaggactgaggagtca

SEQ ID NO: 37441 - DNA, 23 bp, Artificial Sequence
  Synthetic Construct
ccagcaaacaatcccagggtctt

SEQ ID NO: 37442 - DNA, 21 bp, Artificial Sequence
  Synthetic Construct
tgccaggaacaactcaacact

SEQ ID NO: 37443 - DNA, 21 bp, Artificial Sequence
  Synthetic Construct
agcattgtgagtgcctgaaga

SEQ ID NO: 37444 - DNA, 26 bp, Artificial Sequence
  Synthetic Construct
catagctgggagattaaaccagttgt

SEQ ID NO: 37445 - DNA, 19 bp, Artificial Sequence
  Synthetic Construct
tggtccagggctgctgtgt

SEQ ID NO: 37446 - DNA, 24 bp, Artificial Sequence
  Synthetic Construct
actttctgggtgtaagtggtccta

SEQ ID NO: 37447 - DNA, 27 bp, Artificial Sequence
  Synthetic Construct
ccaaatatctgatgccagggaaggata

SEQ ID NO: 37448 - DNA, 23 bp, Artificial Sequence
  Synthetic Construct
ccactggaagaggcactggtatc

SEQ ID NO: 37449 - DNA, 22 bp, Artificial Sequence
  Synthetic Construct
gcaagccagtccataggtgaca

SEQ ID NO: 37450 - DNA, 25 bp, Artificial Sequence
  Synthetic Construct
gtccaactgggttccccaataaaca

SEQ ID NO: 37451 - DNA, 24 bp, Artificial Sequence
  Synthetic Construct
gctttccagagaaatccagcaaca

SEQ ID NO: 37452 - DNA, 19 bp, Artificial Sequence
  Synthetic Construct
ccacgacacccagccaaca

SEQ ID NO: 37453 - DNA, 22 bp, Artificial Sequence
  Synthetic Construct
cacgctcagcctaagcctcttt

SEQ ID NO: 37454 - DNA, 22 bp, Artificial Sequence
  Synthetic Construct
aggacctggttcacagatggtt

SEQ ID NO: 37455 - DNA, 24 bp, Artificial Sequence
  Synthetic Construct
ggcctccattagtctcacccagat

SEQ ID NO: 37456 - DNA, 24 bp, Artificial Sequence
  Synthetic Construct
gctgatgaaagagggaaaggtcta

SEQ ID NO: 37457 - DNA, 21 bp, Artificial Sequence
  Synthetic Construct
tcagatcatgcctggttgcat

SEQ ID NO: 37458 - DNA, 20 bp, Artificial Sequence
  Synthetic Construct
ggcccatctgggatctctgt

SEQ ID NO: 37459 - DNA, 20 bp, Artificial Sequence
  Synthetic Construct
tgggctggggctgcagactt

SEQ ID NO: 37460 - DNA, 19 bp, Artificial Sequence
  Synthetic Construct
tccaggctttgcccaggtt

SEQ ID NO: 37461 - DNA, 18 bp, Artificial Sequence
  Synthetic Construct
acctgggccatccactga

SEQ ID NO: 37462 - DNA, 20 bp, Artificial Sequence
  Synthetic Construct
ccttgacccctgcccatcat

SEQ ID NO: 37463 - DNA, 20 bp, Artificial Sequence
  Synthetic Construct
gctatggctgcctgctgtct

SEQ ID NO: 37464 - DNA, 27 bp, Artificial Sequence
  Synthetic Construct
ccccttctaaagctatctcaggcttca

SEQ ID NO: 37465 - DNA, 23 bp, Artificial Sequence
  Synthetic Construct
gaggtgtcccaagtagcagattg

SEQ ID NO: 37466 - DNA, 23 bp, Artificial Sequence
  Synthetic Construct
gcctttttggtagcccgaatatg

SEQ ID NO: 37467 - DNA, 22 bp, Artificial Sequence
  Synthetic Construct
gccagcctgctcctaaggaaat

SEQ ID NO: 37468 - DNA, 20 bp, Artificial Sequence
  Synthetic Construct
ggccacagcagccagaaaaa

SEQ ID NO: 37469 - DNA, 27 bp, Artificial Sequence
  Synthetic Construct
gacagggcataattggaaagcctttta

SEQ ID NO: 37470 - DNA, 24 bp, Artificial Sequence
  Synthetic Construct
ccagaagggctaagagacttgtca

SEQ ID NO: 37471 - DNA, 20 bp, Artificial Sequence
  Synthetic Construct
tgccctgccccagaggtact

SEQ ID NO: 37472 - DNA, 21 bp, Artificial Sequence
  Synthetic Construct
agcccagacgaatgggttact

SEQ ID NO: 37473 - DNA, 25 bp, Artificial Sequence
  Synthetic Construct
cgtggaataggactcttcagcttgt

SEQ ID NO: 37474 - DNA, 24 bp, Artificial Sequence
  Synthetic Construct
gcaagcaagggcttgaatgtgctt

SEQ ID NO: 37475 - DNA, 26 bp, Artificial Sequence
  Synthetic Construct
ggtccttctcttcaaggaaatgagtt

SEQ ID NO: 37476 - DNA, 25 bp, Artificial Sequence
  Synthetic Construct
ctgataagcacactatcccttcact

SEQ ID NO: 37477 - DNA, 22 bp, Artificial Sequence
  Synthetic Construct
ctgcttcatgttgcaggtctgt

SEQ ID NO: 37478 - DNA, 27 bp, Artificial Sequence
  Synthetic Construct
gtgctgaggttgagaaactctgaatta

SEQ ID NO: 37479 - DNA, 19 bp, Artificial Sequence
  Synthetic Construct
agtggcagcctcacagaga

SEQ ID NO: 37480 - DNA, 20 bp, Artificial Sequence
  Synthetic Construct
gacctcctgactgggagcat

SEQ ID NO: 37481 - DNA, 22 bp, Artificial Sequence
  Synthetic Construct
ggctagcagctgtggagaacat

SEQ ID NO: 37482 - DNA, 22 bp, Artificial Sequence
  Synthetic Construct
ggtagggaagaggcagtgatga

SEQ ID NO: 37483 - DNA, 23 bp, Artificial Sequence
  Synthetic Construct
ggaactggtctgcatgtgttact

SEQ ID NO: 37484 - DNA, 20 bp, Artificial Sequence
  Synthetic Construct
tgcaggagacagcaggacat

SEQ ID NO: 37485 - DNA, 22 bp, Artificial Sequence
  Synthetic Construct
gggccttgctgattctgtgctt

SEQ ID NO: 37486 - DNA, 20 bp, Artificial Sequence
  Synthetic Construct
aggctgcaggtgctacacta

SEQ ID NO: 37487 - DNA, 26 bp, Artificial Sequence
  Synthetic Construct
ggattaacctgtttgggacagctact

SEQ ID NO: 37488 - DNA, 22 bp, Artificial Sequence
  Synthetic Construct
ctactgaaccactgccacttga

SEQ ID NO: 37489 - DNA, 22 bp, Artificial Sequence
  Synthetic Construct
gcctagtggcatctgtggcatt

SEQ ID NO: 37490 - DNA, 24 bp, Artificial Sequence
  Synthetic Construct
cctcttcccactttgcagctattc

SEQ ID NO: 37491 - DNA, 22 bp, Artificial Sequence
  Synthetic Construct
gagtccaagaagcccctcaaat

SEQ ID NO: 37492 - DNA, 24 bp, Artificial Sequence
  Synthetic Construct
cccactacagagcatttactggaa

SEQ ID NO: 37493 - DNA, 26 bp, Artificial Sequence
  Synthetic Construct
ggcagcagaattattacgcagagaca

SEQ ID NO: 37494 - DNA, 23 bp, Artificial Sequence
  Synthetic Construct
cgtgtctccatttgacacagact

SEQ ID NO: 37495 - DNA, 23 bp, Artificial Sequence
  Synthetic Construct
ccagctctccatcctccttcttg

SEQ ID NO: 37496 - DNA, 22 bp, Artificial Sequence
  Synthetic Construct
ccaccctgtttcaaggctggat

SEQ ID NO: 37497 - DNA, 25 bp, Artificial Sequence
  Synthetic Construct
gtgactatagagccatggagtgagt

SEQ ID NO: 37498 - DNA, 20 bp, Artificial Sequence
  Synthetic Construct
tgctgacaagggccacctta

SEQ ID NO: 37499 - DNA, 20 bp, Artificial Sequence
  Synthetic Construct
tgagggcctttctgccacat

SEQ ID NO: 37500 - DNA, 20 bp, Artificial Sequence
  Synthetic Construct
atgatcagggtgggccttgt

SEQ ID NO: 37501 - DNA, 20 bp, Artificial Sequence
  Synthetic Construct
tgctgagtgccctgcatctt

SEQ ID NO: 37502 - DNA, 19 bp, Artificial Sequence
  Synthetic Construct
cttggtatgcgcccctgat

SEQ ID NO: 37503 - DNA, 19 bp, Artificial Sequence
  Synthetic Construct
ccccagctctgtcccgtaa

SEQ ID NO: 37504 - DNA, 25 bp, Artificial Sequence
  Synthetic Construct
ccgttgctatctcaacactgaccat

SEQ ID NO: 37505 - DNA, 24 bp, Artificial Sequence
  Synthetic Construct
tctgtgatattgggccatgcataa

SEQ ID NO: 37506 - DNA, 25 bp, Artificial Sequence
  Synthetic Construct
ctctcaacagagaggatgacctaga

SEQ ID NO: 37507 - DNA, 22 bp, Artificial Sequence
  Synthetic Construct
gcccgcatctttagctgtgctt

SEQ ID NO: 37508 - DNA, 23 bp, Artificial Sequence
  Synthetic Construct
agtgccaaatctctttccccaaa

SEQ ID NO: 37509 - DNA, 22 bp, Artificial Sequence
  Synthetic Construct
tcaattcctggccatgtggaaa

SEQ ID NO: 37510 - DNA, 24 bp, Artificial Sequence
  Synthetic Construct
gcttgctatggtaatggctacagt

SEQ ID NO: 37511 - DNA, 20 bp, Artificial Sequence
  Synthetic Construct
tggccgcttggaaagagaga

SEQ ID NO: 37512 - DNA, 21 bp, Artificial Sequence
  Synthetic Construct
gcgagtcctacacccttgtca

SEQ ID NO: 37513 - DNA, 22 bp, Artificial Sequence
  Synthetic Construct
gggagggccaaagcctaagaaa

SEQ ID NO: 37514 - DNA, 23 bp, Artificial Sequence
  Synthetic Construct
ccatctgcttactccagttctgt

SEQ ID NO: 37515 - DNA, 22 bp, Artificial Sequence
  Synthetic Construct
tccccaagtggaaggagtctct

SEQ ID NO: 37516 - DNA, 25 bp, Artificial Sequence
  Synthetic Construct
gcaataaagttagtccaggctgttg

SEQ ID NO: 37517 - DNA, 28 bp, Artificial Sequence
  Synthetic Construct
ggtccagaaggttaaccaacctgtttac

SEQ ID NO: 37518 - DNA, 28 bp, Artificial Sequence
  Synthetic Construct
caggctgagctctcctatctaatatttc

SEQ ID NO: 37519 - DNA, 26 bp, Artificial Sequence
  Synthetic Construct
gaggctagagaactagtaagcagaga

SEQ ID NO: 37520 - DNA, 21 bp, Artificial Sequence
  Synthetic Construct
tctcaccaaggactcctgcaa

SEQ ID NO: 37521 - DNA, 24 bp, Artificial Sequence
  Synthetic Construct
gcctcaagctttctgtaaaacact

SEQ ID NO: 37522 - DNA, 22 bp, Artificial Sequence
  Synthetic Construct
gtgttccaccagctaggcacat

SEQ ID NO: 37523 - DNA, 23 bp, Artificial Sequence
  Synthetic Construct
gctcaaccagctcactcctcaac

SEQ ID NO: 37524 - DNA, 19 bp, Artificial Sequence
  Synthetic Construct
tggccgtgtggcagtctta

SEQ ID NO: 37525 - DNA, 24 bp, Artificial Sequence
  Synthetic Construct
ggaatcaggatgccatgggatgaa

SEQ ID NO: 37526 - DNA, 21 bp, Artificial Sequence
  Synthetic Construct
aactgaccaaagtggctgtca

SEQ ID NO: 37527 - DNA, 22 bp, Artificial Sequence
  Synthetic Construct
tccccaacccaccattcagttg

SEQ ID NO: 37528 - DNA, 28 bp, Artificial Sequence
  Synthetic Construct
gctaagttcatcacaagtcttggctcta

SEQ ID NO: 37529 - DNA, 27 bp, Artificial Sequence
  Synthetic Construct
cgattatggctctaccggagataattg

SEQ ID NO: 37530 - DNA, 24 bp, Artificial Sequence
  Synthetic Construct
cttgcctgacatttagccttctgt

SEQ ID NO: 37531 - DNA, 25 bp, Artificial Sequence
  Synthetic Construct
gcgtgtgagctatttaagagcagat

SEQ ID NO: 37532 - DNA, 22 bp, Artificial Sequence
  Synthetic Construct
ccttagcttccagccattgtgt

SEQ ID NO: 37533 - DNA, 30 bp, Artificial Sequence
  Synthetic Construct
ggacaagtgaaataatcaaggggtggtact

SEQ ID NO: 37534 - DNA, 23 bp, Artificial Sequence
  Synthetic Construct
ccctctggctaggggctcattta

SEQ ID NO: 37535 - DNA, 22 bp, Artificial Sequence
  Synthetic Construct
ctccagcgacccttgctatttg

SEQ ID NO: 37536 - DNA, 19 bp, Artificial Sequence
  Synthetic Construct
gcactgccacctgctgatt

SEQ ID NO: 37537 - DNA, 29 bp, Artificial Sequence
  Synthetic Construct
gggaaaatgttttgaccaaggagttctct

SEQ ID NO: 37538 - DNA, 25 bp, Artificial Sequence
  Synthetic Construct
tcaggaagcaactaaaaggttccat

SEQ ID NO: 37539 - DNA, 19 bp, Artificial Sequence
  Synthetic Construct
aggcgccgagagcaagcta

SEQ ID NO: 37540 - DNA, 20 bp, Artificial Sequence
  Synthetic Construct
ctgcaggcctccatcttgtt

SEQ ID NO: 37541 - DNA, 24 bp, Artificial Sequence
  Synthetic Construct
ggctgatcttattgcagtggaact

SEQ ID NO: 37542 - DNA, 22 bp, Artificial Sequence
  Synthetic Construct
ccctctgtggaagaatgtgtga

SEQ ID NO: 37543 - DNA, 24 bp, Artificial Sequence
  Synthetic Construct
cagcagatcctacagacctgtttc

SEQ ID NO: 37544 - DNA, 25 bp, Artificial Sequence
  Synthetic Construct
gtcttatcgtcttcacagggttctt

SEQ ID NO: 37545 - DNA, 22 bp, Artificial Sequence
  Synthetic Construct
ctgaccctgagcctgctttttg

SEQ ID NO: 37546 - DNA, 21 bp, Artificial Sequence
  Synthetic Construct
tgccagccttccacaaacttc

SEQ ID NO: 37547 - DNA, 25 bp, Artificial Sequence
  Synthetic Construct
gtttgtcctcctttatcaccacact

SEQ ID NO: 37548 - DNA, 19 bp, Artificial Sequence
  Synthetic Construct
agtgggccttgtcctgtga

SEQ ID NO: 37549 - DNA, 21 bp, Artificial Sequence
  Synthetic Construct
ggagcctgaaccactgcatga

SEQ ID NO: 37550 - DNA, 22 bp, Artificial Sequence
  Synthetic Construct
aagggagggccaggactctaaa

SEQ ID NO: 37551 - DNA, 23 bp, Artificial Sequence
  Synthetic Construct
ccccttcctgggtaccacctaat

SEQ ID NO: 37552 - DNA, 22 bp, Artificial Sequence
  Synthetic Construct
ggtcacagctttccccatcata

SEQ ID NO: 37553 - DNA, 30 bp, Artificial Sequence
  Synthetic Construct
cccttgaaatacctaatttcttgcccttct

SEQ ID NO: 37554 - DNA, 19 bp, Artificial Sequence
  Synthetic Construct
atgccccacccctccacaa

SEQ ID NO: 37555 - DNA, 24 bp, Artificial Sequence
  Synthetic Construct
ccctgctgggcactatatcacctt

SEQ ID NO: 37556 - DNA, 20 bp, Artificial Sequence
  Synthetic Construct
ggaggtgcctttgccaaaca

SEQ ID NO: 37557 - DNA, 20 bp, Artificial Sequence
  Synthetic Construct
ggactttgggccgtaaggaa

SEQ ID NO: 37558 - DNA, 25 bp, Artificial Sequence
  Synthetic Construct
ggcttaaagagtgaccaagcaccta

SEQ ID NO: 37559 - DNA, 30 bp, Artificial Sequence
  Synthetic Construct
ggaatgttgtcttaaataagcccctactga

SEQ ID NO: 37560 - DNA, 26 bp, Artificial Sequence
  Synthetic Construct
gaatttctgcttactgggccaatatc

SEQ ID NO: 37561 - DNA, 23 bp, Artificial Sequence
  Synthetic Construct
cactccaccgtgcttttctctct

SEQ ID NO: 37562 - DNA, 19 bp, Artificial Sequence
  Synthetic Construct
agggtggcagccttcttct

SEQ ID NO: 37563 - DNA, 20 bp, Artificial Sequence
  Synthetic Construct
ccagccgcttcaggtgatct

SEQ ID NO: 37564 - DNA, 27 bp, Artificial Sequence
  Synthetic Construct
caatacttttaagaagcccctcctttc

SEQ ID NO: 37565 - DNA, 26 bp, Artificial Sequence
  Synthetic Construct
ctttttgggcttaccatcactacaga

SEQ ID NO: 37566 - DNA, 22 bp, Artificial Sequence
  Synthetic Construct
cttcttctcactggtgggcaat

SEQ ID NO: 37567 - DNA, 27 bp, Artificial Sequence
  Synthetic Construct
ctgtggaaataaaggttgggatgaaag

SEQ ID NO: 37568 - DNA, 26 bp, Artificial Sequence
  Synthetic Construct
cctcaggactggagtttacacgaagt

SEQ ID NO: 37569 - DNA, 21 bp, Artificial Sequence
  Synthetic Construct
cgaggaccccaggcaattcaa

SEQ ID NO: 37570 - DNA, 21 bp, Artificial Sequence
  Synthetic Construct
ccgataggagggagggagctt

SEQ ID NO: 37571 - DNA, 24 bp, Artificial Sequence
  Synthetic Construct
gaggcaggacgatttcttgaccta

SEQ ID NO: 37572 - DNA, 21 bp, Artificial Sequence
  Synthetic Construct
aggccgagccagatcctattg

SEQ ID NO: 37573 - DNA, 19 bp, Artificial Sequence
  Synthetic Construct
acccacccaggccagtttc

SEQ ID NO: 37574 - DNA, 23 bp, Artificial Sequence
  Synthetic Construct
gcaaggctagagttttcgagttc

SEQ ID NO: 37575 - DNA, 18 bp, Artificial Sequence
  Synthetic Construct
taagccagggcgcccaaa

SEQ ID NO: 37576 - DNA, 23 bp, Artificial Sequence
  Synthetic Construct
cagatggcaagtgtccagggtaa

SEQ ID NO: 37577 - DNA, 21 bp, Artificial Sequence
  Synthetic Construct
ttgcctcctggttaccacttc

SEQ ID NO: 37578 - DNA, 18 bp, Artificial Sequence
  Synthetic Construct
tctcgcggctcgcttttc

SEQ ID NO: 37579 - DNA, 23 bp, Artificial Sequence
  Synthetic Construct
tgggatatgaagggcaggttttg

SEQ ID NO: 37580 - DNA, 22 bp, Artificial Sequence
  Synthetic Construct
ggtctgaaactcctgggctcaa

SEQ ID NO: 37581 - DNA, 21 bp, Artificial Sequence
  Synthetic Construct
ccctgtgagggcaggatgaac

SEQ ID NO: 37582 - DNA, 22 bp, Artificial Sequence
  Synthetic Construct
gaggaacaagggcaaggtgatg

SEQ ID NO: 37583 - DNA, 21 bp, Artificial Sequence
  Synthetic Construct
ctggtcacactaaggcaccat

SEQ ID NO: 37584 - DNA, 25 bp, Artificial Sequence
  Synthetic Construct
gggaggggatttaaggtcacaaaac

SEQ ID NO: 37585 - DNA, 24 bp, Artificial Sequence
  Synthetic Construct
ggtgtgactgtgtgtttacaggtt

SEQ ID NO: 37586 - DNA, 25 bp, Artificial Sequence
  Synthetic Construct
ctctggattaggacccagaaacttg

SEQ ID NO: 37587 - DNA, 25 bp, Artificial Sequence
  Synthetic Construct
gagacagaatccagagctgtagaag

SEQ ID NO: 37588 - DNA, 20 bp, Artificial Sequence
  Synthetic Construct
tcaccgccatgcccaagaat

SEQ ID NO: 37589 - DNA, 23 bp, Artificial Sequence
  Synthetic Construct
atgtttagaaccccgtggaatgt

SEQ ID NO: 37590 - DNA, 25 bp, Artificial Sequence
  Synthetic Construct
ccagctacctcctacaggtgctatt

SEQ ID NO: 37591 - DNA, 25 bp, Artificial Sequence
  Synthetic Construct
gcccactgaagaaattgggacatac

SEQ ID NO: 37592 - DNA, 26 bp, Artificial Sequence
  Synthetic Construct
ggatcatccaaaggggtcatatctct

SEQ ID NO: 37593 - DNA, 22 bp, Artificial Sequence
  Synthetic Construct
gaccccatatgctccagggttt

SEQ ID NO: 37594 - DNA, 20 bp, Artificial Sequence
  Synthetic Construct
tgactgctgtgggcagaact

SEQ ID NO: 37595 - DNA, 24 bp, Artificial Sequence
  Synthetic Construct
gcgctaaaccacagcagtataaaa

SEQ ID NO: 37596 - DNA, 25 bp, Artificial Sequence
  Synthetic Construct
gggcttcttttccacctatcaattc

SEQ ID NO: 37597 - DNA, 27 bp, Artificial Sequence
  Synthetic Construct
gcactaagggttcttgctacaatcaga

SEQ ID NO: 37598 - DNA, 22 bp, Artificial Sequence
  Synthetic Construct
gcagggtgttgctctgtcatca

SEQ ID NO: 37599 - DNA, 20 bp, Artificial Sequence
  Synthetic Construct
gccagtcctgctgtgtccaa

SEQ ID NO: 37600 - DNA, 22 bp, Artificial Sequence
  Synthetic Construct
tgtgagaccagcttcctctagt

SEQ ID NO: 37601 - DNA, 21 bp, Artificial Sequence
  Synthetic Construct
caatgcccttctcaccacgta

SEQ ID NO: 37602 - DNA, 21 bp, Artificial Sequence
  Synthetic Construct
gcccacagccctacccatttt

SEQ ID NO: 37603 - DNA, 23 bp, Artificial Sequence
  Synthetic Construct
ttcacttcctagcaggtctctct

SEQ ID NO: 37604 - DNA, 24 bp, Artificial Sequence
  Synthetic Construct
ccaaagccctttccatgagctaga

SEQ ID NO: 37605 - DNA, 26 bp, Artificial Sequence
  Synthetic Construct
ggtatctgaatcagccaggactgtag

SEQ ID NO: 37606 - DNA, 24 bp, Artificial Sequence
  Synthetic Construct
aaagatgcaagagtccttggtttg

SEQ ID NO: 37607 - DNA, 23 bp, Artificial Sequence
  Synthetic Construct
cccacatgctctcacacatttac

SEQ ID NO: 37608 - DNA, 21 bp, Artificial Sequence
  Synthetic Construct
agcagcactgaggcctgtctt

SEQ ID NO: 37609 - DNA, 22 bp, Artificial Sequence
  Synthetic Construct
aggcaaagtcaacatgcagaga

SEQ ID NO: 37610 - DNA, 26 bp, Artificial Sequence
  Synthetic Construct
gtggatataagctcccagtgggtaag

SEQ ID NO: 37611 - DNA, 23 bp, Artificial Sequence
  Synthetic Construct
cagctaactaacgtggggacttc

SEQ ID NO: 37612 - DNA, 19 bp, Artificial Sequence
  Synthetic Construct
acctgctgctgggtgaaga

SEQ ID NO: 37613 - DNA, 24 bp, Artificial Sequence
  Synthetic Construct
gggctcctagggaaagcaaaccta

SEQ ID NO: 37614 - DNA, 25 bp, Artificial Sequence
  Synthetic Construct
ctgttggttttggagtcaggtcaga

SEQ ID NO: 37615 - DNA, 21 bp, Artificial Sequence
  Synthetic Construct
gagtgcttacgtgtggtgcat

SEQ ID NO: 37616 - DNA, 22 bp, Artificial Sequence
  Synthetic Construct
aggctctcagtggtggtgttag

SEQ ID NO: 37617 - DNA, 20 bp, Artificial Sequence
  Synthetic Construct
ggtttgccctgctggaaatg

SEQ ID NO: 37618 - DNA, 20 bp, Artificial Sequence
  Synthetic Construct
agggcaagtggtgtgagaga

SEQ ID NO: 37619 - DNA, 23 bp, Artificial Sequence
  Synthetic Construct
tccctacctctcctcccatctca

SEQ ID NO: 37620 - DNA, 26 bp, Artificial Sequence
  Synthetic Construct
ctcctttccctagaccgtaagcaata

SEQ ID NO: 37621 - DNA, 23 bp, Artificial Sequence
  Synthetic Construct
gatacctttctggggagggagta

SEQ ID NO: 37622 - DNA, 24 bp, Artificial Sequence
  Synthetic Construct
tgtctaagaggtgatgggtgacta

SEQ ID NO: 37623 - DNA, 22 bp, Artificial Sequence
  Synthetic Construct
ctcctgggaaactctgccttga

SEQ ID NO: 37624 - DNA, 23 bp, Artificial Sequence
  Synthetic Construct
gtggaagccattgtgtacgatca

SEQ ID NO: 37625 - DNA, 22 bp, Artificial Sequence
  Synthetic Construct
tggcgagtaattttggcacctt

SEQ ID NO: 37626 - DNA, 22 bp, Artificial Sequence
  Synthetic Construct
gcccagccgttccaggatttat

SEQ ID NO: 37627 - DNA, 21 bp, Artificial Sequence
  Synthetic Construct
aaaccatcctggaggcagaac

SEQ ID NO: 37628 - DNA, 24 bp, Artificial Sequence
  Synthetic Construct
gatcaggaaaatccaaccctgtga

SEQ ID NO: 37629 - DNA, 21 bp, Artificial Sequence
  Synthetic Construct
cggggtatcgggagtctgaca

SEQ ID NO: 37630 - DNA, 26 bp, Artificial Sequence
  Synthetic Construct
ccagttctgcctgaggtgaatgtact

SEQ ID NO: 37631 - DNA, 24 bp, Artificial Sequence
  Synthetic Construct
gctgctctgaaaacctctgcttga

SEQ ID NO: 37632 - DNA, 25 bp, Artificial Sequence
  Synthetic Construct
cacatggaatgtactgtctgcaagt

SEQ ID NO: 37633 - DNA, 22 bp, Artificial Sequence
  Synthetic Construct
gtgctgcctaggtaccagtttc

SEQ ID NO: 37634 - DNA, 22 bp, Artificial Sequence
  Synthetic Construct
tggtagggctcccttcctctat

SEQ ID NO: 37635 - DNA, 23 bp, Artificial Sequence
  Synthetic Construct
agttctttgtctctgcgatgtgt

SEQ ID NO: 37636 - DNA, 22 bp, Artificial Sequence
  Synthetic Construct
ggtaagtgtccctgggtctgat

SEQ ID NO: 37637 - DNA, 23 bp, Artificial Sequence
  Synthetic Construct
ggcctatggcttaacacgagaga

SEQ ID NO: 37638 - DNA, 23 bp, Artificial Sequence
  Synthetic Construct
gggataacaaggggccagatagt

SEQ ID NO: 37639 - DNA, 23 bp, Artificial Sequence
  Synthetic Construct
ttccatacaatccaggccagaag

SEQ ID NO: 37640 - DNA, 20 bp, Artificial Sequence
  Synthetic Construct
ggctgcactacctgaacaca

SEQ ID NO: 37641 - DNA, 24 bp, Artificial Sequence
  Synthetic Construct
ctctcaagctagttcttgctcagt

SEQ ID NO: 37642 - DNA, 24 bp, Artificial Sequence
  Synthetic Construct
ggagaagctttccaccttctggtt

SEQ ID NO: 37643 - DNA, 22 bp, Artificial Sequence
  Synthetic Construct
ggctgtcagcacttcggactta

SEQ ID NO: 37644 - DNA, 20 bp, Artificial Sequence
  Synthetic Construct
ttcggccccacagtgcagtt

SEQ ID NO: 37645 - DNA, 24 bp, Artificial Sequence
  Synthetic Construct
atctccaaactgtgagtctggttt

SEQ ID NO: 37646 - DNA, 22 bp, Artificial Sequence
  Synthetic Construct
gcctgatgctccatcctcacat

SEQ ID NO: 37647 - DNA, 25 bp, Artificial Sequence
  Synthetic Construct
ggtaataagactgaccatcgcacaa

SEQ ID NO: 37648 - DNA, 21 bp, Artificial Sequence
  Synthetic Construct
acaggtcagcccaggaccaaa

SEQ ID NO: 37649 - DNA, 23 bp, Artificial Sequence
  Synthetic Construct
cttggcatcccagacctacctaa

SEQ ID NO: 37650 - DNA, 24 bp, Artificial Sequence
  Synthetic Construct
tggttgtaaggaaagttggaggaa

SEQ ID NO: 37651 - DNA, 20 bp, Artificial Sequence
  Synthetic Construct
tgggaggtggtagggagttg

SEQ ID NO: 37652 - DNA, 25 bp, Artificial Sequence
  Synthetic Construct
cgtcatttgaattcgggacttgtct

SEQ ID NO: 37653 - DNA, 21 bp, Artificial Sequence
  Synthetic Construct
cctgaccctgctacctgtgtt

SEQ ID NO: 37654 - DNA, 25 bp, Artificial Sequence
  Synthetic Construct
ggatgtcttcaatcctggctgatgt

SEQ ID NO: 37655 - DNA, 20 bp, Artificial Sequence
  Synthetic Construct
tgggcctgggatttctcgtt

SEQ ID NO: 37656 - DNA, 22 bp, Artificial Sequence
  Synthetic Construct
aggcatcggtctgaaggacttg

SEQ ID NO: 37657 - DNA, 22 bp, Artificial Sequence
  Synthetic Construct
gtggagactgtgctgcctaaca

SEQ ID NO: 37658 - DNA, 22 bp, Artificial Sequence
  Synthetic Construct
tctctggggccaggtacaaaag

SEQ ID NO: 37659 - DNA, 20 bp, Artificial Sequence
  Synthetic Construct
tgcttccagaggggcactgt

SEQ ID NO: 37660 - DNA, 24 bp, Artificial Sequence
  Synthetic Construct
ggtgcctaattttcagcacagtct

SEQ ID NO: 37661 - DNA, 23 bp, Artificial Sequence
  Synthetic Construct
tgctgtgacagagtgttgtgaag

SEQ ID NO: 37662 - DNA, 19 bp, Artificial Sequence
  Synthetic Construct
agcaggagctgtgctctga

SEQ ID NO: 37663 - DNA, 22 bp, Artificial Sequence
  Synthetic Construct
agctacagtccccagcctgaat

SEQ ID NO: 37664 - DNA, 29 bp, Artificial Sequence
  Synthetic Construct
ggatggactaatataaggtctggctcaca

SEQ ID NO: 37665 - DNA, 22 bp, Artificial Sequence
  Synthetic Construct
gacaggcacaccttctccttct

SEQ ID NO: 37666 - DNA, 27 bp, Artificial Sequence
  Synthetic Construct
ctggagagttcacagattaacagaaga

SEQ ID NO: 37667 - DNA, 23 bp, Artificial Sequence
  Synthetic Construct
ttcagtctcaggagcgctgactt

SEQ ID NO: 37668 - DNA, 23 bp, Artificial Sequence
  Synthetic Construct
cattttgctacagctggggtctt

SEQ ID NO: 37669 - DNA, 22 bp, Artificial Sequence
  Synthetic Construct
tcttccagagctgagacccttt

SEQ ID NO: 37670 - DNA, 22 bp, Artificial Sequence
  Synthetic Construct
gccagccttcttccccaagata

SEQ ID NO: 37671 - DNA, 26 bp, Artificial Sequence
  Synthetic Construct
ccagcaaaaattgagagctggcaaag

SEQ ID NO: 37672 - DNA, 23 bp, Artificial Sequence
  Synthetic Construct
ctctgggtgtcagtagcttcttt

SEQ ID NO: 37673 - DNA, 27 bp, Artificial Sequence
  Synthetic Construct
ctacactgcagaagtagcttaaacttg

SEQ ID NO: 37674 - DNA, 24 bp, Artificial Sequence
  Synthetic Construct
tgtttgctataaagtcgggcaaga

SEQ ID NO: 37675 - DNA, 24 bp, Artificial Sequence
  Synthetic Construct
gacttatggcttgagcctctgctt

SEQ ID NO: 37676 - DNA, 19 bp, Artificial Sequence
  Synthetic Construct
acccctgccccaactgtct

SEQ ID NO: 37677 - DNA, 22 bp, Artificial Sequence
  Synthetic Construct
ctacctccaccattccctctga

SEQ ID NO: 37678 - DNA, 22 bp, Artificial Sequence
  Synthetic Construct
cttggtggagaggtacgctaag

SEQ ID NO: 37679 - DNA, 22 bp, Artificial Sequence
  Synthetic Construct
ccaaggggtcctcactgtctct

SEQ ID NO: 37680 - DNA, 23 bp, Artificial Sequence
  Synthetic Construct
gctccatttcctggttcccatgt

SEQ ID NO: 37681 - DNA, 25 bp, Artificial Sequence
  Synthetic Construct
cagagagtggggtagtatactcaga

SEQ ID NO: 37682 - DNA, 20 bp, Artificial Sequence
  Synthetic Construct
ggatgaggctgacactgcat

SEQ ID NO: 37683 - DNA, 20 bp, Artificial Sequence
  Synthetic Construct
actcaagtgcagccccgata

SEQ ID NO: 37684 - DNA, 23 bp, Artificial Sequence
  Synthetic Construct
gtgaatcaaagcggaacttgtca

SEQ ID NO: 37685 - DNA, 24 bp, Artificial Sequence
  Synthetic Construct
cgctttgtgaaggacaccccaatc

SEQ ID NO: 37686 - DNA, 23 bp, Artificial Sequence
  Synthetic Construct
cagaccactccccttacaactga

SEQ ID NO: 37687 - DNA, 26 bp, Artificial Sequence
  Synthetic Construct
ctgtatgtcttacgcttcctcccaat

SEQ ID NO: 37688 - DNA, 20 bp, Artificial Sequence
  Synthetic Construct
tccggggaggaccactcaca

SEQ ID NO: 37689 - DNA, 22 bp, Artificial Sequence
  Synthetic Construct
gactctccccaggaatgaccta

SEQ ID NO: 37690 - DNA, 19 bp, Artificial Sequence
  Synthetic Construct
ccagtgcagatggcagcat

SEQ ID NO: 37691 - DNA, 22 bp, Artificial Sequence
  Synthetic Construct
ctcctgttgccctggataggaa

SEQ ID NO: 37692 - DNA, 21 bp, Artificial Sequence
  Synthetic Construct
ccccttgccttggactgaaag

SEQ ID NO: 37693 - DNA, 19 bp, Artificial Sequence
  Synthetic Construct
gctggcgattgccgtctct

SEQ ID NO: 37694 - DNA, 20 bp, Artificial Sequence
  Synthetic Construct
accacactgctcgggatgta

SEQ ID NO: 37695 - DNA, 20 bp, Artificial Sequence
  Synthetic Construct
aatgcaggcagtggcctaag

SEQ ID NO: 37696 - DNA, 19 bp, Artificial Sequence
  Synthetic Construct
tgcgccagctatggacaca

SEQ ID NO: 37697 - DNA, 27 bp, Artificial Sequence
  Synthetic Construct
ggtgtcatcttaaatcttggaccacaa

SEQ ID NO: 37698 - DNA, 23 bp, Artificial Sequence
  Synthetic Construct
aaaatcaggcctgttgtccttct

SEQ ID NO: 37699 - DNA, 19 bp, Artificial Sequence
  Synthetic Construct
acacccggttacgcagaga

SEQ ID NO: 37700 - DNA, 24 bp, Artificial Sequence
  Synthetic Construct
cacaagtaagagctgctgagcaat

SEQ ID NO: 37701 - DNA, 21 bp, Artificial Sequence
  Synthetic Construct
agggaccgaggaggttactct

SEQ ID NO: 37702 - DNA, 20 bp, Artificial Sequence
  Synthetic Construct
gctgcagccagagcctaaga

SEQ ID NO: 37703 - DNA, 25 bp, Artificial Sequence
  Synthetic Construct
ggctatgggttgatcagaacctgaa

SEQ ID NO: 37704 - DNA, 20 bp, Artificial Sequence
  Synthetic Construct
agcaaggggtgtgtgagcaa

SEQ ID NO: 37705 - DNA, 22 bp, Artificial Sequence
  Synthetic Construct
ccttcagcacaggctttctaca

SEQ ID NO: 37706 - DNA, 21 bp, Artificial Sequence
  Synthetic Construct
agggacagcacagatggatga

SEQ ID NO: 37707 - DNA, 24 bp, Artificial Sequence
  Synthetic Construct
tgcggtatgacatgaggaagaatc

SEQ ID NO: 37708 - DNA, 22 bp, Artificial Sequence
  Synthetic Construct
gagtgctttcagcccaagaaca

SEQ ID NO: 37709 - DNA, 25 bp, Artificial Sequence
  Synthetic Construct
cgggagccttccctaagaaggtttt

SEQ ID NO: 37710 - DNA, 20 bp, Artificial Sequence
  Synthetic Construct
agtacggagaaggccaccaa

SEQ ID NO: 37711 - DNA, 20 bp, Artificial Sequence
  Synthetic Construct
agctagccccacttgcattg

SEQ ID NO: 37712 - DNA, 25 bp, Artificial Sequence
  Synthetic Construct
tgatcagaatgagttcggaggtttg

SEQ ID NO: 37713 - DNA, 22 bp, Artificial Sequence
  Synthetic Construct
acctaggaaggggtcaggttct

SEQ ID NO: 37714 - DNA, 21 bp, Artificial Sequence
  Synthetic Construct
cgccttcatggtgatctgtgt

SEQ ID NO: 37715 - DNA, 24 bp, Artificial Sequence
  Synthetic Construct
acttgttcagggtcagaggagtag

SEQ ID NO: 37716 - DNA, 21 bp, Artificial Sequence
  Synthetic Construct
aagccttccacagctctcatc

SEQ ID NO: 37717 - DNA, 20 bp, Artificial Sequence
  Synthetic Construct
agcagctacgaggcccttca

SEQ ID NO: 37718 - DNA, 22 bp, Artificial Sequence
  Synthetic Construct
ctgtcgcacatttcctgcgaat

SEQ ID NO: 37719 - DNA, 21 bp, Artificial Sequence
  Synthetic Construct
ggcgtagatgccaaagcatac

SEQ ID NO: 37720 - DNA, 23 bp, Artificial Sequence
  Synthetic Construct
ctggagattgaattgccccgaat

SEQ ID NO: 37721 - DNA, 26 bp, Artificial Sequence
  Synthetic Construct
ggcagtggaagcctttgataccaatc

SEQ ID NO: 37722 - DNA, 25 bp, Artificial Sequence
  Synthetic Construct
ccctggaaccttccaagttcacact

SEQ ID NO: 37723 - DNA, 22 bp, Artificial Sequence
  Synthetic Construct
cccagccatttagtgcctgctt

SEQ ID NO: 37724 - DNA, 23 bp, Artificial Sequence
  Synthetic Construct
gaccacgaaagtatcggcgaaaa

SEQ ID NO: 37725 - DNA, 22 bp, Artificial Sequence
  Synthetic Construct
tcaaagaggcaaagcactggat

SEQ ID NO: 37726 - DNA, 23 bp, Artificial Sequence
  Synthetic Construct
gcaaggctacctaggcagagaag

SEQ ID NO: 37727 - DNA, 18 bp, Artificial Sequence
  Synthetic Construct
acgcacatgccgaggaaa

SEQ ID NO: 37728 - DNA, 27 bp, Artificial Sequence
  Synthetic Construct
cagtccaacttaaaactagagcagctt

SEQ ID NO: 37729 - DNA, 25 bp, Artificial Sequence
  Synthetic Construct
ctctctaggacgaggaagctaaact

SEQ ID NO: 37730 - DNA, 23 bp, Artificial Sequence
  Synthetic Construct
gacacaccacagtgaaacgatga

SEQ ID NO: 37731 - DNA, 26 bp, Artificial Sequence
  Synthetic Construct
gtgtgtgtggtttataggctgtcatc

SEQ ID NO: 37732 - DNA, 24 bp, Artificial Sequence
  Synthetic Construct
gctcaagcaatcctggcactgtag

SEQ ID NO: 37733 - DNA, 25 bp, Artificial Sequence
  Synthetic Construct
ccgcaagatggtgaaagtccagcta

SEQ ID NO: 37734 - DNA, 27 bp, Artificial Sequence
  Synthetic Construct
gagtgaagaacacttgactgactcttg

SEQ ID NO: 37735 - DNA, 28 bp, Artificial Sequence
  Synthetic Construct
gctgaatgaaatgaacaggacactggtt

SEQ ID NO: 37736 - DNA, 20 bp, Artificial Sequence
  Synthetic Construct
ccagaccccatgcagcattt

SEQ ID NO: 37737 - DNA, 22 bp, Artificial Sequence
  Synthetic Construct
acatggtccttggggtggatac

SEQ ID NO: 37738 - DNA, 24 bp, Artificial Sequence
  Synthetic Construct
ggcactggaagttcctagaaatca

SEQ ID NO: 37739 - DNA, 23 bp, Artificial Sequence
  Synthetic Construct
cactagttgccatgtaccgagaa

SEQ ID NO: 37740 - DNA, 22 bp, Artificial Sequence
  Synthetic Construct
gcctttgtaaaagcgacccaaa

SEQ ID NO: 37741 - DNA, 25 bp, Artificial Sequence
  Synthetic Construct
agacaaacctcttggtctcaaaaca

SEQ ID NO: 37742 - DNA, 25 bp, Artificial Sequence
  Synthetic Construct
ggacaggagcagctatctagaatca

SEQ ID NO: 37743 - DNA, 22 bp, Artificial Sequence
  Synthetic Construct
gcaagggcagaacctagagcaa

SEQ ID NO: 37744 - DNA, 20 bp, Artificial Sequence
  Synthetic Construct
agtggaaggctgtggggata

SEQ ID NO: 37745 - DNA, 22 bp, Artificial Sequence
  Synthetic Construct
gagaggcattccttgcttctga

SEQ ID NO: 37746 - DNA, 20 bp, Artificial Sequence
  Synthetic Construct
acggccaagacgtggtaagt

SEQ ID NO: 37747 - DNA, 22 bp, Artificial Sequence
  Synthetic Construct
gcgtggagcagtgagaaagtct

SEQ ID NO: 37748 - DNA, 27 bp, Artificial Sequence
  Synthetic Construct
gggagtaagagatacaggacaccatct

SEQ ID NO: 37749 - DNA, 23 bp, Artificial Sequence
  Synthetic Construct
cctgttcacatcccatcccttct

SEQ ID NO: 37750 - DNA, 25 bp, Artificial Sequence
  Synthetic Construct
ctggaattttcagggttcacagctt

SEQ ID NO: 37751 - DNA, 24 bp, Artificial Sequence
  Synthetic Construct
gtttttcccttttgtggggagttg

SEQ ID NO: 37752 - DNA, 24 bp, Artificial Sequence
  Synthetic Construct
cacagatcactgcccaatcagaca

SEQ ID NO: 37753 - DNA, 22 bp, Artificial Sequence
  Synthetic Construct
tcgaattcctctccccgcagaa

SEQ ID NO: 37754 - DNA, 21 bp, Artificial Sequence
  Synthetic Construct
ctgttgttgtgcccaggcttt

SEQ ID NO: 37755 - DNA, 22 bp, Artificial Sequence
  Synthetic Construct
gtcctctaggggcccttcaaat

SEQ ID NO: 37756 - DNA, 20 bp, Artificial Sequence
  Synthetic Construct
ccttggcactccccactgtt

SEQ ID NO: 37757 - DNA, 27 bp, Artificial Sequence
  Synthetic Construct
ccagatataacacggaaacagccaaag

SEQ ID NO: 37758 - DNA, 19 bp, Artificial Sequence
  Synthetic Construct
aaccgaggcggctggaaca

SEQ ID NO: 37759 - DNA, 20 bp, Artificial Sequence
  Synthetic Construct
ctgtgtgcagagcactgtgt

SEQ ID NO: 37760 - DNA, 23 bp, Artificial Sequence
  Synthetic Construct
ggatgttgcagccttcctgttag

SEQ ID NO: 37761 - DNA, 20 bp, Artificial Sequence
  Synthetic Construct
tgcacaccgctccccagatt

SEQ ID NO: 37762 - DNA, 18 bp, Artificial Sequence
  Synthetic Construct
tcgtctcgtgcagcgttt

SEQ ID NO: 37763 - DNA, 22 bp, Artificial Sequence
  Synthetic Construct
cagctttggggtgagggtaaag

SEQ ID NO: 37764 - DNA, 21 bp, Artificial Sequence
  Synthetic Construct
ccctggagaggggtcttttct

SEQ ID NO: 37765 - DNA, 28 bp, Artificial Sequence
  Synthetic Construct
ccaggcttttgttcgtttttcagtcatc

SEQ ID NO: 37766 - DNA, 20 bp, Artificial Sequence
  Synthetic Construct
tgtggggaatgagcgagtca

SEQ ID NO: 37767 - DNA, 24 bp, Artificial Sequence
  Synthetic Construct
cacttgcagtttaccctgtgactt

SEQ ID NO: 37768 - DNA, 22 bp, Artificial Sequence
  Synthetic Construct
ggttggcctatggaaggtgcat

SEQ ID NO: 37769 - DNA, 25 bp, Artificial Sequence
  Synthetic Construct
ccattgcctgcttgtcaaaatgaac

SEQ ID NO: 37770 - DNA, 23 bp, Artificial Sequence
  Synthetic Construct
aagaaggaatggatgtgccaagt

SEQ ID NO: 37771 - DNA, 19 bp, Artificial Sequence
  Synthetic Construct
ccaccctccccactccttt

SEQ ID NO: 37772 - DNA, 19 bp, Artificial Sequence
  Synthetic Construct
agctggaggagggcagaga

SEQ ID NO: 37773 - DNA, 27 bp, Artificial Sequence
  Synthetic Construct
ggagagggtaaacaacaagcagaggta

SEQ ID NO: 37774 - DNA, 24 bp, Artificial Sequence
  Synthetic Construct
gcgtgtgctgagaaactggatttg

SEQ ID NO: 37775 - DNA, 22 bp, Artificial Sequence
  Synthetic Construct
ggcaggattgcacttccttact

SEQ ID NO: 37776 - DNA, 24 bp, Artificial Sequence
  Synthetic Construct
ggaggagaagccattggtgggtat

SEQ ID NO: 37777 - DNA, 25 bp, Artificial Sequence
  Synthetic Construct
agtaaagtggaggaactcaaagcat

SEQ ID NO: 37778 - DNA, 19 bp, Artificial Sequence
  Synthetic Construct
tggagctgggcttcagaga

SEQ ID NO: 37779 - DNA, 18 bp, Artificial Sequence
  Synthetic Construct
agtgcggcctggagcaaa

SEQ ID NO: 37780 - DNA, 22 bp, Artificial Sequence
  Synthetic Construct
cccatctgactgcaagcactac

SEQ ID NO: 37781 - DNA, 20 bp, Artificial Sequence
  Synthetic Construct
accgccacgcaaaagcctaa

SEQ ID NO: 37782 - DNA, 24 bp, Artificial Sequence
  Synthetic Construct
gttggagtagagtggtacaagcat

SEQ ID NO: 37783 - DNA, 21 bp, Artificial Sequence
  Synthetic Construct
cgatgtccagcaaagctccta

SEQ ID NO: 37784 - DNA, 26 bp, Artificial Sequence
  Synthetic Construct
cccctcctccagtatttccaatccaa

SEQ ID NO: 37785 - DNA, 22 bp, Artificial Sequence
  Synthetic Construct
agtcctgtgttagcctctgttg

SEQ ID NO: 37786 - DNA, 22 bp, Artificial Sequence
  Synthetic Construct
ggaactggatgtggctgacagt

SEQ ID NO: 37787 - DNA, 21 bp, Artificial Sequence
  Synthetic Construct
gacatgagcttggccttccat

SEQ ID NO: 37788 - DNA, 22 bp, Artificial Sequence
  Synthetic Construct
tgagagtcgtacagcagcaaat

SEQ ID NO: 37789 - DNA, 21 bp, Artificial Sequence
  Synthetic Construct
cctgggccccaaagacagttt

SEQ ID NO: 37790 - DNA, 24 bp, Artificial Sequence
  Synthetic Construct
cacatcagtgcaatccctgctttc

SEQ ID NO: 37791 - DNA, 21 bp, Artificial Sequence
  Synthetic Construct
tgccctcgaaatcctgtgaga

SEQ ID NO: 37792 - DNA, 23 bp, Artificial Sequence
  Synthetic Construct
ggcaagtttcaccaagccgatga

SEQ ID NO: 37793 - DNA, 20 bp, Artificial Sequence
  Synthetic Construct
tctgtccaggagacctgcaa

SEQ ID NO: 37794 - DNA, 21 bp, Artificial Sequence
  Synthetic Construct
gagaatcagtgggagctgcat

SEQ ID NO: 37795 - DNA, 23 bp, Artificial Sequence
  Synthetic Construct
gggtcaccattttgcctccttct

SEQ ID NO: 37796 - DNA, 25 bp, Artificial Sequence
  Synthetic Construct
aggtaatcacttggcagtaatgctt

SEQ ID NO: 37797 - DNA, 20 bp, Artificial Sequence
  Synthetic Construct
tagcagtctgggcagccata

SEQ ID NO: 37798 - DNA, 22 bp, Artificial Sequence
  Synthetic Construct
tctggtgacctcgttgagtagt

SEQ ID NO: 37799 - DNA, 25 bp, Artificial Sequence
  Synthetic Construct
gccatgtgtatttagtgctggtctt

SEQ ID NO: 37800 - DNA, 20 bp, Artificial Sequence
  Synthetic Construct
accacccaggcaagggaaat

SEQ ID NO: 37801 - DNA, 22 bp, Artificial Sequence
  Synthetic Construct
tgtggtcccactctggcttatg

SEQ ID NO: 37802 - DNA, 19 bp, Artificial Sequence
  Synthetic Construct
ccaaggggtgccgtagtga

SEQ ID NO: 37803 - DNA, 19 bp, Artificial Sequence
  Synthetic Construct
tctgcgggcagctgttaga

SEQ ID NO: 37804 - DNA, 19 bp, Artificial Sequence
  Synthetic Construct
tgggcagacaggtgagctt

SEQ ID NO: 37805 - DNA, 23 bp, Artificial Sequence
  Synthetic Construct
gacagccattcatccccagtttc

SEQ ID NO: 37806 - DNA, 23 bp, Artificial Sequence
  Synthetic Construct
accaaatgcccagctatatgtgt

SEQ ID NO: 37807 - DNA, 20 bp, Artificial Sequence
  Synthetic Construct
gctcagaggtcacggtcaca

SEQ ID NO: 37808 - DNA, 20 bp, Artificial Sequence
  Synthetic Construct
tgctgtgtccttgacagcaa

SEQ ID NO: 37809 - DNA, 24 bp, Artificial Sequence
  Synthetic Construct
ctatcagtaggtttggcacaggat

SEQ ID NO: 37810 - DNA, 20 bp, Artificial Sequence
  Synthetic Construct
tccttgccacaggccctcat

SEQ ID NO: 37811 - DNA, 21 bp, Artificial Sequence
  Synthetic Construct
gctgtaggagccagggcaaaa

SEQ ID NO: 37812 - DNA, 24 bp, Artificial Sequence
  Synthetic Construct
gcttcaacaatgaggggcgtctac

SEQ ID NO: 37813 - DNA, 20 bp, Artificial Sequence
  Synthetic Construct
aggtgagaggagcaggtgtt

SEQ ID NO: 37814 - DNA, 24 bp, Artificial Sequence
  Synthetic Construct
gattaacaacactcttgcgcacat

SEQ ID NO: 37815 - DNA, 22 bp, Artificial Sequence
  Synthetic Construct
gaaggagctgcagatggaatca

SEQ ID NO: 37816 - DNA, 21 bp, Artificial Sequence
  Synthetic Construct
aggagtcatgctgggctatgt

SEQ ID NO: 37817 - DNA, 24 bp, Artificial Sequence
  Synthetic Construct
ggctgtggcttgggaggagtataa

SEQ ID NO: 37818 - DNA, 20 bp, Artificial Sequence
  Synthetic Construct
gctgctgccttggacagaaa

SEQ ID NO: 37819 - DNA, 25 bp, Artificial Sequence
  Synthetic Construct
gtgaagtaacaaggactctgtctca

SEQ ID NO: 37820 - DNA, 25 bp, Artificial Sequence
  Synthetic Construct
gccaatgaggcaatatggccaatga

SEQ ID NO: 37821 - DNA, 19 bp, Artificial Sequence
  Synthetic Construct
gcagggctgatggccctat

SEQ ID NO: 37822 - DNA, 26 bp, Artificial Sequence
  Synthetic Construct
tctatccagtatctacatgcccttga

SEQ ID NO: 37823 - DNA, 24 bp, Artificial Sequence
  Synthetic Construct
gtactttctgcctcagaacgatga

SEQ ID NO: 37824 - DNA, 24 bp, Artificial Sequence
  Synthetic Construct
ggcggagatagagctatgaactga

SEQ ID NO: 37825 - DNA, 27 bp, Artificial Sequence
  Synthetic Construct
ggtgggtaggttctaagcacacctaag

SEQ ID NO: 37826 - DNA, 23 bp, Artificial Sequence
  Synthetic Construct
ccaaagccatgatctggggatct

SEQ ID NO: 37827 - DNA, 22 bp, Artificial Sequence
  Synthetic Construct
gaggtcagggtaaggcagagat

SEQ ID NO: 37828 - DNA, 19 bp, Artificial Sequence
  Synthetic Construct
gccttgggcacgtcacttc

SEQ ID NO: 37829 - DNA, 25 bp, Artificial Sequence
  Synthetic Construct
ggttctcttcccaactatcccattg

SEQ ID NO: 37830 - DNA, 24 bp, Artificial Sequence
  Synthetic Construct
gacgtgcaaaatcactgagagaca

SEQ ID NO: 37831 - DNA, 23 bp, Artificial Sequence
  Synthetic Construct
gcaggaaagcagctcttttggta

SEQ ID NO: 37832 - DNA, 24 bp, Artificial Sequence
  Synthetic Construct
acacaggcctgatattttctcaca

SEQ ID NO: 37833 - DNA, 21 bp, Artificial Sequence
  Synthetic Construct
acaggtggagcaggtcagtct

SEQ ID NO: 37834 - DNA, 21 bp, Artificial Sequence
  Synthetic Construct
gttgggttggcttgtcctgaa

SEQ ID NO: 37835 - DNA, 23 bp, Artificial Sequence
  Synthetic Construct
ggctcttagaagtggcctgtgtt

SEQ ID NO: 37836 - DNA, 20 bp, Artificial Sequence
  Synthetic Construct
agacccggcctgggctttct

SEQ ID NO: 37837 - DNA, 26 bp, Artificial Sequence
  Synthetic Construct
ggcaattacaacagtcagtcttcaca

SEQ ID NO: 37838 - DNA, 23 bp, Artificial Sequence
  Synthetic Construct
gcactggagtttgagcacagctt

SEQ ID NO: 37839 - DNA, 24 bp, Artificial Sequence
  Synthetic Construct
gctggaggaaggaagcatggtgaa

SEQ ID NO: 37840 - DNA, 24 bp, Artificial Sequence
  Synthetic Construct
cctataagcttgctggaggtctct

SEQ ID NO: 37841 - DNA, 22 bp, Artificial Sequence
  Synthetic Construct
cctccacccttgtatcgtgagt

SEQ ID NO: 37842 - DNA, 22 bp, Artificial Sequence
  Synthetic Construct
ctctgcatacaccctcctgtga

SEQ ID NO: 37843 - DNA, 22 bp, Artificial Sequence
  Synthetic Construct
aacttacgggcccagggaatac

SEQ ID NO: 37844 - DNA, 26 bp, Artificial Sequence
  Synthetic Construct
gcaggatggtgttaattcagggagat

SEQ ID NO: 37845 - DNA, 22 bp, Artificial Sequence
  Synthetic Construct
aggtttctaggtggggctgaag

SEQ ID NO: 37846 - DNA, 21 bp, Artificial Sequence
  Synthetic Construct
acctctcctccacagccagta

SEQ ID NO: 37847 - DNA, 25 bp, Artificial Sequence
  Synthetic Construct
ggagtagagcaggagttgggaatag

SEQ ID NO: 37848 - DNA, 20 bp, Artificial Sequence
  Synthetic Construct
tcccagagctgacccgataa

SEQ ID NO: 37849 - DNA, 20 bp, Artificial Sequence
  Synthetic Construct
ggcagccaacgattggtact

SEQ ID NO: 37850 - DNA, 20 bp, Artificial Sequence
  Synthetic Construct
tcctcacctccaggcttcat

SEQ ID NO: 37851 - DNA, 23 bp, Artificial Sequence
  Synthetic Construct
gaagaatctcagagccccgttac

SEQ ID NO: 37852 - DNA, 25 bp, Artificial Sequence
  Synthetic Construct
ggcttaattggaggggaagggagat

SEQ ID NO: 37853 - DNA, 22 bp, Artificial Sequence
  Synthetic Construct
caatcagtcccacggtccattc

SEQ ID NO: 37854 - DNA, 27 bp, Artificial Sequence
  Synthetic Construct
gcctgtatttgaaagggtttgtcttac

SEQ ID NO: 37855 - DNA, 22 bp, Artificial Sequence
  Synthetic Construct
tgaggctggcttccaaatttca

SEQ ID NO: 37856 - DNA, 25 bp, Artificial Sequence
  Synthetic Construct
aagtgaaggcataaggtatcgttct

SEQ ID NO: 37857 - DNA, 20 bp, Artificial Sequence
  Synthetic Construct
cggaagtccagcaggcctaa

SEQ ID NO: 37858 - DNA, 20 bp, Artificial Sequence
  Synthetic Construct
gggaagcttgggctttgcta

SEQ ID NO: 37859 - DNA, 23 bp, Artificial Sequence
  Synthetic Construct
gccaaatgcaaaagccaggtgat

SEQ ID NO: 37860 - DNA, 24 bp, Artificial Sequence
  Synthetic Construct
cggcctcatccagacttctgttac

SEQ ID NO: 37861 - DNA, 25 bp, Artificial Sequence
  Synthetic Construct
cacactgagctataaggcaggaaac

SEQ ID NO: 37862 - DNA, 18 bp, Artificial Sequence
  Synthetic Construct
tgccagctggggaagagt

SEQ ID NO: 37863 - DNA, 23 bp, Artificial Sequence
  Synthetic Construct
gtggatgggatctgtctgagcat

SEQ ID NO: 37864 - DNA, 21 bp, Artificial Sequence
  Synthetic Construct
tgacccaccaggaccacagtt

SEQ ID NO: 37865 - DNA, 20 bp, Artificial Sequence
  Synthetic Construct
tagcaggggccacagcttag

SEQ ID NO: 37866 - DNA, 24 bp, Artificial Sequence
  Synthetic Construct
gcactgtttttagacacgaagaca

SEQ ID NO: 37867 - DNA, 19 bp, Artificial Sequence
  Synthetic Construct
atggcgctggtgcttggaa

SEQ ID NO: 37868 - DNA, 20 bp, Artificial Sequence
  Synthetic Construct
atagggctgcctcccagaga

SEQ ID NO: 37869 - DNA, 27 bp, Artificial Sequence
  Synthetic Construct
ctgactactgtcaaagagttagggaat

SEQ ID NO: 37870 - DNA, 22 bp, Artificial Sequence
  Synthetic Construct
gagtcacctgtagccagctcaa

SEQ ID NO: 37871 - DNA, 23 bp, Artificial Sequence
  Synthetic Construct
ccagttgaagctctctgatggtt

SEQ ID NO: 37872 - DNA, 22 bp, Artificial Sequence
  Synthetic Construct
ctcacagggcccattcattaca

SEQ ID NO: 37873 - DNA, 21 bp, Artificial Sequence
  Synthetic Construct
cccaggccttaccgaggttta

SEQ ID NO: 37874 - DNA, 27 bp, Artificial Sequence
  Synthetic Construct
gcctgttaatactccagtgaggagaag

SEQ ID NO: 37875 - DNA, 20 bp, Artificial Sequence
  Synthetic Construct
cacaacctgagtgccgagaa

SEQ ID NO: 37876 - DNA, 20 bp, Artificial Sequence
  Synthetic Construct
ttcctcccaggaggggtaca

SEQ ID NO: 37877 - DNA, 18 bp, Artificial Sequence
  Synthetic Construct
tcaggcaccccgctgttt

SEQ ID NO: 37878 - DNA, 27 bp, Artificial Sequence
  Synthetic Construct
ggccaaaaggtgaaacactgtccttga

SEQ ID NO: 37879 - DNA, 22 bp, Artificial Sequence
  Synthetic Construct
cttgccaagcaaattggtgact

SEQ ID NO: 37880 - DNA, 25 bp, Artificial Sequence
  Synthetic Construct
ccaaggttatggagtgtcctacttc

SEQ ID NO: 37881 - DNA, 20 bp, Artificial Sequence
  Synthetic Construct
gcatgctgccctacttgtca

SEQ ID NO: 37882 - DNA, 21 bp, Artificial Sequence
  Synthetic Construct
cccagtggcttccacaagtga

SEQ ID NO: 37883 - DNA, 23 bp, Artificial Sequence
  Synthetic Construct
ggacaactagggacagcctctct

SEQ ID NO: 37884 - DNA, 22 bp, Artificial Sequence
  Synthetic Construct
tcagcagtgtgaggggttgatg

SEQ ID NO: 37885 - DNA, 20 bp, Artificial Sequence
  Synthetic Construct
tgagtcacgtgccggcatta

SEQ ID NO: 37886 - DNA, 24 bp, Artificial Sequence
  Synthetic Construct
cagtgtagactgctttctgtgcaa

SEQ ID NO: 37887 - DNA, 24 bp, Artificial Sequence
  Synthetic Construct
tgtgttctcagttgtctgggtaag

SEQ ID NO: 37888 - DNA, 24 bp, Artificial Sequence
  Synthetic Construct
ccaggtacctccatgccatagaca

SEQ ID NO: 37889 - DNA, 24 bp, Artificial Sequence
  Synthetic Construct
ggggaacactcaggtcttgtgaga

SEQ ID NO: 37890 - DNA, 26 bp, Artificial Sequence
  Synthetic Construct
gaggataaatggaagaggaggaggtt

SEQ ID NO: 37891 - DNA, 25 bp, Artificial Sequence
  Synthetic Construct
gtgactcattccaggtgtagaggat

SEQ ID NO: 37892 - DNA, 24 bp, Artificial Sequence
  Synthetic Construct
aaaagtagggcagtcaccttgatt

SEQ ID NO: 37893 - DNA, 20 bp, Artificial Sequence
  Synthetic Construct
acgtgcaagcagtgcgttag

SEQ ID NO: 37894 - DNA, 22 bp, Artificial Sequence
  Synthetic Construct
cctggctttgctctccacattg

SEQ ID NO: 37895 - DNA, 21 bp, Artificial Sequence
  Synthetic Construct
cctgcttcactctgtggcata

SEQ ID NO: 37896 - DNA, 26 bp, Artificial Sequence
  Synthetic Construct
gggaaaaacatgtacagctcctctca

SEQ ID NO: 37897 - DNA, 20 bp, Artificial Sequence
  Synthetic Construct
tggaacaggcctcaggctaa

SEQ ID NO: 37898 - DNA, 20 bp, Artificial Sequence
  Synthetic Construct
gcaccataggacagcagtgt

SEQ ID NO: 37899 - DNA, 25 bp, Artificial Sequence
  Synthetic Construct
gcctaactcttcccttgttctgtgt

SEQ ID NO: 37900 - DNA, 20 bp, Artificial Sequence
  Synthetic Construct
tcccgctgtccccatcaaga

SEQ ID NO: 37901 - DNA, 22 bp, Artificial Sequence
  Synthetic Construct
tgggctaatccactctgtctga

SEQ ID NO: 37902 - DNA, 21 bp, Artificial Sequence
  Synthetic Construct
caagccaactcagggcttgaa

SEQ ID NO: 37903 - DNA, 24 bp, Artificial Sequence
  Synthetic Construct
ggtgactgtgttcctcctcacgaa

SEQ ID NO: 37904 - DNA, 23 bp, Artificial Sequence
  Synthetic Construct
gcctcctgaggcttaggtcaatg

SEQ ID NO: 37905 - DNA, 21 bp, Artificial Sequence
  Synthetic Construct
aagccatccccagcccacatt

SEQ ID NO: 37906 - DNA, 22 bp, Artificial Sequence
  Synthetic Construct
ggagaaatgggacgcaggagat

SEQ ID NO: 37907 - DNA, 20 bp, Artificial Sequence
  Synthetic Construct
ccccagcaccaccttattgt

SEQ ID NO: 37908 - DNA, 19 bp, Artificial Sequence
  Synthetic Construct
tctccggccgtccagcttt

SEQ ID NO: 37909 - DNA, 24 bp, Artificial Sequence
  Synthetic Construct
tgttcagctcctaaaatggcatca

SEQ ID NO: 37910 - DNA, 24 bp, Artificial Sequence
  Synthetic Construct
gggaagaacacaccagctgccaaa

SEQ ID NO: 37911 - DNA, 23 bp, Artificial Sequence
  Synthetic Construct
ggatgccctaggtgagtttggaa

SEQ ID NO: 37912 - DNA, 22 bp, Artificial Sequence
  Synthetic Construct
ccccacaaaactggcactgaga

SEQ ID NO: 37913 - DNA, 23 bp, Artificial Sequence
  Synthetic Construct
ggggctgtggtttcagaatcagt

SEQ ID NO: 37914 - DNA, 22 bp, Artificial Sequence
  Synthetic Construct
agaacaggggagacagtgagaa

SEQ ID NO: 37915 - DNA, 22 bp, Artificial Sequence
  Synthetic Construct
aagaccagcagaggacctggaa

SEQ ID NO: 37916 - DNA, 22 bp, Artificial Sequence
  Synthetic Construct
tgccctatgctagaacccaaga

SEQ ID NO: 37917 - DNA, 20 bp, Artificial Sequence
  Synthetic Construct
gcgggaaccatgcattctct

SEQ ID NO: 37918 - DNA, 26 bp, Artificial Sequence
  Synthetic Construct
gcctgttggatggtcatagacactac

SEQ ID NO: 37919 - DNA, 27 bp, Artificial Sequence
  Synthetic Construct
gtcacagggatttgaagatactacact

SEQ ID NO: 37920 - DNA, 20 bp, Artificial Sequence
  Synthetic Construct
ttctgagcggaagcctgaac

SEQ ID NO: 37921 - DNA, 22 bp, Artificial Sequence
  Synthetic Construct
caccagtcaaggaggctgtaag

SEQ ID NO: 37922 - DNA, 23 bp, Artificial Sequence
  Synthetic Construct
gtacagcttctaccagcagttca

SEQ ID NO: 37923 - DNA, 25 bp, Artificial Sequence
  Synthetic Construct
ggttgtacacttgcttttgcacttg

SEQ ID NO: 37924 - DNA, 25 bp, Artificial Sequence
  Synthetic Construct
gacacaagaactgggaatggaggaa

SEQ ID NO: 37925 - DNA, 25 bp, Artificial Sequence
  Synthetic Construct
gtcagatgttgtcttcacactccta

SEQ ID NO: 37926 - DNA, 20 bp, Artificial Sequence
  Synthetic Construct
tcagcctagcctctcccaaa

SEQ ID NO: 37927 - DNA, 24 bp, Artificial Sequence
  Synthetic Construct
agagcttggatctgcgagaattag

SEQ ID NO: 37928 - DNA, 23 bp, Artificial Sequence
  Synthetic Construct
acaaccacagaaggatgtcaact

SEQ ID NO: 37929 - DNA, 26 bp, Artificial Sequence
  Synthetic Construct
ggataggatgtgggcgaaattcttac

SEQ ID NO: 37930 - DNA, 25 bp, Artificial Sequence
  Synthetic Construct
gctttcctctagggttggactgtga

SEQ ID NO: 37931 - DNA, 23 bp, Artificial Sequence
  Synthetic Construct
cggtgtccctaggctgagataac

SEQ ID NO: 37932 - DNA, 24 bp, Artificial Sequence
  Synthetic Construct
gcacaactttatcttggccctgaa

SEQ ID NO: 37933 - DNA, 24 bp, Artificial Sequence
  Synthetic Construct
ggcccagtctatgaggaactgttg

SEQ ID NO: 37934 - DNA, 23 bp, Artificial Sequence
  Synthetic Construct
gtctcaattcctctggcccttgt

SEQ ID NO: 37935 - DNA, 22 bp, Artificial Sequence
  Synthetic Construct
ccctaacaggcttcctcacaca

SEQ ID NO: 37936 - DNA, 23 bp, Artificial Sequence
  Synthetic Construct
gagggatgtgaggaagcctttac

SEQ ID NO: 37937 - DNA, 23 bp, Artificial Sequence
  Synthetic Construct
tccccgtggtcatattcagagaa

SEQ ID NO: 37938 - DNA, 22 bp, Artificial Sequence
  Synthetic Construct
ccagtggtggatcagtcctcaa

SEQ ID NO: 37939 - DNA, 23 bp, Artificial Sequence
  Synthetic Construct
ggggaggagacccaatccaaatc

SEQ ID NO: 37940 - DNA, 24 bp, Artificial Sequence
  Synthetic Construct
gacactggggacaaataggctgaa

SEQ ID NO: 37941 - DNA, 20 bp, Artificial Sequence
  Synthetic Construct
cagcaactgcgtggagagaa

SEQ ID NO: 37942 - DNA, 22 bp, Artificial Sequence
  Synthetic Construct
ttcagggacctccaccatcttg

SEQ ID NO: 37943 - DNA, 22 bp, Artificial Sequence
  Synthetic Construct
aggcaaagtccaaccccagaag

SEQ ID NO: 37944 - DNA, 20 bp, Artificial Sequence
  Synthetic Construct
caccgccacatgcaatcatc

SEQ ID NO: 37945 - DNA, 27 bp, Artificial Sequence
  Synthetic Construct
cctcacttctaagagtagcagcctttc

SEQ ID NO: 37946 - DNA, 18 bp, Artificial Sequence
  Synthetic Construct
cgcaggccttgtggaaca

SEQ ID NO: 37947 - DNA, 21 bp, Artificial Sequence
  Synthetic Construct
ccaccaaggtacgcacagaca

SEQ ID NO: 37948 - DNA, 25 bp, Artificial Sequence
  Synthetic Construct
gatacaagaacactgtgccctatct

SEQ ID NO: 37949 - DNA, 28 bp, Artificial Sequence
  Synthetic Construct
gcagtaatgcctctgaatacaccactgt

SEQ ID NO: 37950 - DNA, 25 bp, Artificial Sequence
  Synthetic Construct
gacatttctgggctatgtggtcgat

SEQ ID NO: 37951 - DNA, 20 bp, Artificial Sequence
  Synthetic Construct
aacttgcccttggcgtgcat

SEQ ID NO: 37952 - DNA, 24 bp, Artificial Sequence
  Synthetic Construct
cccaggtactgactgatactgaga

SEQ ID NO: 37953 - DNA, 25 bp, Artificial Sequence
  Synthetic Construct
ttctaagctcctagagggaaagact

SEQ ID NO: 37954 - DNA, 24 bp, Artificial Sequence
  Synthetic Construct
agaatagtgtgagctggattgtgt

SEQ ID NO: 37955 - DNA, 20 bp, Artificial Sequence
  Synthetic Construct
cgtgaagtccttggccacat

SEQ ID NO: 37956 - DNA, 24 bp, Artificial Sequence
  Synthetic Construct
ggtcccacttgacaacaagcaaag

SEQ ID NO: 37957 - DNA, 27 bp, Artificial Sequence
  Synthetic Construct
ctggtaagttttccaaatggtggtgta

SEQ ID NO: 37958 - DNA, 23 bp, Artificial Sequence
  Synthetic Construct
gctgctcccatgaaatccactct

SEQ ID NO: 37959 - DNA, 21 bp, Artificial Sequence
  Synthetic Construct
gggacagcgacagtcctgatg

SEQ ID NO: 37960 - DNA, 19 bp, Artificial Sequence
  Synthetic Construct
tggggtgggagacggtaga

SEQ ID NO: 37961 - DNA, 21 bp, Artificial Sequence
  Synthetic Construct
tggaagagggcgataccatgt

SEQ ID NO: 37962 - DNA, 24 bp, Artificial Sequence
  Synthetic Construct
catctgagtagagaagcaccaaca

SEQ ID NO: 37963 - DNA, 25 bp, Artificial Sequence
  Synthetic Construct
gtgtattggcaggcttgatctctca

SEQ ID NO: 37964 - DNA, 23 bp, Artificial Sequence
  Synthetic Construct
cccttcataatccagtggacaca

SEQ ID NO: 37965 - DNA, 21 bp, Artificial Sequence
  Synthetic Construct
ccagaccacgagctcctcaaa

SEQ ID NO: 37966 - DNA, 20 bp, Artificial Sequence
  Synthetic Construct
tccagggcctgagccacaaa

SEQ ID NO: 37967 - DNA, 21 bp, Artificial Sequence
  Synthetic Construct
agagtcatccagcccctccat

SEQ ID NO: 37968 - DNA, 22 bp, Artificial Sequence
  Synthetic Construct
gtggtcacattggcaggaattg

SEQ ID NO: 37969 - DNA, 20 bp, Artificial Sequence
  Synthetic Construct
accaggctgtgggacagaca

SEQ ID NO: 37970 - DNA, 22 bp, Artificial Sequence
  Synthetic Construct
caaaagcagggcttcctttgaa

SEQ ID NO: 37971 - DNA, 22 bp, Artificial Sequence
  Synthetic Construct
ggggtgcagtggcacaatcata

SEQ ID NO: 37972 - DNA, 21 bp, Artificial Sequence
  Synthetic Construct
gttgggctggctaaaccgata

SEQ ID NO: 37973 - DNA, 20 bp, Artificial Sequence
  Synthetic Construct
agggcccttgttcacacaca

SEQ ID NO: 37974 - DNA, 20 bp, Artificial Sequence
  Synthetic Construct
tccccactgaatgcggtgtt

SEQ ID NO: 37975 - DNA, 24 bp, Artificial Sequence
  Synthetic Construct
gtcagcttgcaaagctcctttaga

SEQ ID NO: 37976 - DNA, 22 bp, Artificial Sequence
  Synthetic Construct
tgccacatgctctctcccaaac

SEQ ID NO: 37977 - DNA, 23 bp, Artificial Sequence
  Synthetic Construct
ctgttagggccctgtttgtcttg

SEQ ID NO: 37978 - DNA, 21 bp, Artificial Sequence
  Synthetic Construct
tgaggaaggaagaccctgcat

SEQ ID NO: 37979 - DNA, 22 bp, Artificial Sequence
  Synthetic Construct
ggacttccccgcaatacgaaag

SEQ ID NO: 37980 - DNA, 26 bp, Artificial Sequence
  Synthetic Construct
tccatcttctctgtacagtgtctact

SEQ ID NO: 37981 - DNA, 20 bp, Artificial Sequence
  Synthetic Construct
agccctcctcggacccatgt

SEQ ID NO: 37982 - DNA, 23 bp, Artificial Sequence
  Synthetic Construct
gaagaggctgttagaagcgtagt

SEQ ID NO: 37983 - DNA, 22 bp, Artificial Sequence
  Synthetic Construct
gcagtagtccagcctgagtttc

SEQ ID NO: 37984 - DNA, 20 bp, Artificial Sequence
  Synthetic Construct
tgccggcctcagcctcagta

SEQ ID NO: 37985 - DNA, 22 bp, Artificial Sequence
  Synthetic Construct
ccccagccatagtctctgattc

SEQ ID NO: 37986 - DNA, 22 bp, Artificial Sequence
  Synthetic Construct
cctggtctctcagccttagtca

SEQ ID NO: 37987 - DNA, 24 bp, Artificial Sequence
  Synthetic Construct
agtgaagacaaagtcctcctgaag

SEQ ID NO: 37988 - DNA, 29 bp, Artificial Sequence
  Synthetic Construct
ggcaaggaattataacttaggccctggaa

SEQ ID NO: 37989 - DNA, 20 bp, Artificial Sequence
  Synthetic Construct
tcccagggcacactatgact

SEQ ID NO: 37990 - DNA, 22 bp, Artificial Sequence
  Synthetic Construct
atttgcacccatgtctgtctga

SEQ ID NO: 37991 - DNA, 20 bp, Artificial Sequence
  Synthetic Construct
tgcaggaggccagagaacat

SEQ ID NO: 37992 - DNA, 24 bp, Artificial Sequence
  Synthetic Construct
gccccatccctttgccttatcttc

SEQ ID NO: 37993 - DNA, 20 bp, Artificial Sequence
  Synthetic Construct
gtgtcacacgctgagaggtt

SEQ ID NO: 37994 - DNA, 25 bp, Artificial Sequence
  Synthetic Construct
cctgcaacaagagataagcccaact

SEQ ID NO: 37995 - DNA, 20 bp, Artificial Sequence
  Synthetic Construct
tgagccactgtgcctggata

SEQ ID NO: 37996 - DNA, 29 bp, Artificial Sequence
  Synthetic Construct
cagtttagatatgcttagccagtccttca

SEQ ID NO: 37997 - DNA, 20 bp, Artificial Sequence
  Synthetic Construct
tcacctcaccttggcctttg

SEQ ID NO: 37998 - DNA, 25 bp, Artificial Sequence
  Synthetic Construct
caaacacatgctttcctcaaacaag

SEQ ID NO: 37999 - DNA, 23 bp, Artificial Sequence
  Synthetic Construct
gaggatactgaggcatggggata

SEQ ID NO: 38000 - DNA, 22 bp, Artificial Sequence
  Synthetic Construct
ggcatggggaggaagtacacat

SEQ ID NO: 38001 - DNA, 21 bp, Artificial Sequence
  Synthetic Construct
tgaaaaggccttgtgggtcaa

SEQ ID NO: 38002 - DNA, 20 bp, Artificial Sequence
  Synthetic Construct
aactactgcccaggctggaa

SEQ ID NO: 38003 - DNA, 23 bp, Artificial Sequence
  Synthetic Construct
gaatgcttcatgcgacacgaaaa

SEQ ID NO: 38004 - DNA, 24 bp, Artificial Sequence
  Synthetic Construct
ccagctgtcattttagggcagact

SEQ ID NO: 38005 - DNA, 21 bp, Artificial Sequence
  Synthetic Construct
ccctgaagccctgtgtcttct

SEQ ID NO: 38006 - DNA, 27 bp, Artificial Sequence
  Synthetic Construct
ggagtttctgtctcttttcccctagaa

SEQ ID NO: 38007 - DNA, 20 bp, Artificial Sequence
  Synthetic Construct
cttgatctggcaggcagctt

SEQ ID NO: 38008 - DNA, 23 bp, Artificial Sequence
  Synthetic Construct
acagaaccctttcacacgtgatt

SEQ ID NO: 38009 - DNA, 28 bp, Artificial Sequence
  Synthetic Construct
gcctgtatgatattcaggtcacttcttc

SEQ ID NO: 38010 - DNA, 22 bp, Artificial Sequence
  Synthetic Construct
gccaaccagttctttgggagaa

SEQ ID NO: 38011 - DNA, 24 bp, Artificial Sequence
  Synthetic Construct
gaaagcagccaggattacaaccta

SEQ ID NO: 38012 - DNA, 20 bp, Artificial Sequence
  Synthetic Construct
tcctgcctgtccccagtgta

SEQ ID NO: 38013 - DNA, 22 bp, Artificial Sequence
  Synthetic Construct
gagagggtgagacggtagaaac

SEQ ID NO: 38014 - DNA, 27 bp, Artificial Sequence
  Synthetic Construct
cacctgaagcatttttcatcctgttca

SEQ ID NO: 38015 - DNA, 18 bp, Artificial Sequence
  Synthetic Construct
agtgcggccacaagcatt

SEQ ID NO: 38016 - DNA, 25 bp, Artificial Sequence
  Synthetic Construct
gacatcttctacagctctgccaaaa

SEQ ID NO: 38017 - DNA, 18 bp, Artificial Sequence
  Synthetic Construct
ctgcactgccctgtgctt

SEQ ID NO: 38018 - DNA, 21 bp, Artificial Sequence
  Synthetic Construct
accagtggcttccccacaaca

SEQ ID NO: 38019 - DNA, 22 bp, Artificial Sequence
  Synthetic Construct
ggacttctgtgggatgagcatt

SEQ ID NO: 38020 - DNA, 22 bp, Artificial Sequence
  Synthetic Construct
agccctttccacacctctcctt

SEQ ID NO: 38021 - DNA, 21 bp, Artificial Sequence
  Synthetic Construct
tgccctctgcagggaatggta

SEQ ID NO: 38022 - DNA, 24 bp, Artificial Sequence
  Synthetic Construct
gcagccaggagcaacttgtactca

SEQ ID NO: 38023 - DNA, 26 bp, Artificial Sequence
  Synthetic Construct
ctcttctctagaccacaggtttccat

SEQ ID NO: 38024 - DNA, 21 bp, Artificial Sequence
  Synthetic Construct
gtgcgaaagactggagcaatc

SEQ ID NO: 38025 - DNA, 20 bp, Artificial Sequence
  Synthetic Construct
ggacagcaccaactctgctt

SEQ ID NO: 38026 - DNA, 23 bp, Artificial Sequence
  Synthetic Construct
agcattaatgggcaacaggagat

SEQ ID NO: 38027 - DNA, 26 bp, Artificial Sequence
  Synthetic Construct
gatagttgagcagagaaacaggaaga

SEQ ID NO: 38028 - DNA, 25 bp, Artificial Sequence
  Synthetic Construct
tcataggcatctggagggacaataa

SEQ ID NO: 38029 - DNA, 25 bp, Artificial Sequence
  Synthetic Construct
gcatgacgtcagaaaccatgcttca

SEQ ID NO: 38030 - DNA, 24 bp, Artificial Sequence
  Synthetic Construct
gtggaaacccgattccctttggta

SEQ ID NO: 38031 - DNA, 23 bp, Artificial Sequence
  Synthetic Construct
tgaccaaaccaaaacacctgtga

SEQ ID NO: 38032 - DNA, 22 bp, Artificial Sequence
  Synthetic Construct
gtggtctccctggtgctagttt

SEQ ID NO: 38033 - DNA, 20 bp, Artificial Sequence
  Synthetic Construct
cgagacccgatccctgaagt

SEQ ID NO: 38034 - DNA, 20 bp, Artificial Sequence
  Synthetic Construct
atagccgagccgccatgttt

SEQ ID NO: 38035 - DNA, 24 bp, Artificial Sequence
  Synthetic Construct
ggtggcaaaatgaccagagcagtt

SEQ ID NO: 38036 - DNA, 19 bp, Artificial Sequence
  Synthetic Construct
gggctccggggtaaagtct

SEQ ID NO: 38037 - DNA, 20 bp, Artificial Sequence
  Synthetic Construct
tgcaccaggcactgtgttag

SEQ ID NO: 38038 - DNA, 22 bp, Artificial Sequence
  Synthetic Construct
cacagccttccagggagaagaa

SEQ ID NO: 38039 - DNA, 25 bp, Artificial Sequence
  Synthetic Construct
ccatgagagtacccactctgtccaa

SEQ ID NO: 38040 - DNA, 21 bp, Artificial Sequence
  Synthetic Construct
tgggtgggtgtgaggaccaat

SEQ ID NO: 38041 - DNA, 29 bp, Artificial Sequence
  Synthetic Construct
gaggatgaaatgatatagaggggcttcat

SEQ ID NO: 38042 - DNA, 28 bp, Artificial Sequence
  Synthetic Construct
cactcagagtagaaggcaaagtccttac

SEQ ID NO: 38043 - DNA, 22 bp, Artificial Sequence
  Synthetic Construct
ccccaatgctaactcccctaga

SEQ ID NO: 38044 - DNA, 22 bp, Artificial Sequence
  Synthetic Construct
gcctccacaatcctcccaggta

SEQ ID NO: 38045 - DNA, 27 bp, Artificial Sequence
  Synthetic Construct
gcactaagaagttgctttgctgtctac

SEQ ID NO: 38046 - DNA, 21 bp, Artificial Sequence
  Synthetic Construct
cccagccattccctccaacat

SEQ ID NO: 38047 - DNA, 26 bp, Artificial Sequence
  Synthetic Construct
gcatatcccttgactgttccctcaaa

SEQ ID NO: 38048 - DNA, 22 bp, Artificial Sequence
  Synthetic Construct
tgccagtagggagtcactgaga

SEQ ID NO: 38049 - DNA, 21 bp, Artificial Sequence
  Synthetic Construct
ccaaggcagcaggatcatttg

SEQ ID NO: 38050 - DNA, 22 bp, Artificial Sequence
  Synthetic Construct
ctttccggtctccctacacact

SEQ ID NO: 38051 - DNA, 22 bp, Artificial Sequence
  Synthetic Construct
catagatggggcatcactgtgt

SEQ ID NO: 38052 - DNA, 22 bp, Artificial Sequence
  Synthetic Construct
ccagtagacccaccatgtctgt

SEQ ID NO: 38053 - DNA, 23 bp, Artificial Sequence
  Synthetic Construct
gcagagagtgcatgagtttcaca

SEQ ID NO: 38054 - DNA, 24 bp, Artificial Sequence
  Synthetic Construct
gtgcgtgagaatagatgctgacat

SEQ ID NO: 38055 - DNA, 20 bp, Artificial Sequence
  Synthetic Construct
ggtggtggggtcaactccta

SEQ ID NO: 38056 - DNA, 20 bp, Artificial Sequence
  Synthetic Construct
tagcctgactgtgggagtgt

SEQ ID NO: 38057 - DNA, 21 bp, Artificial Sequence
  Synthetic Construct
aggccctgttactggcagaga

SEQ ID NO: 38058 - DNA, 22 bp, Artificial Sequence
  Synthetic Construct
gctgcacagctcgtagctctaa

SEQ ID NO: 38059 - DNA, 21 bp, Artificial Sequence
  Synthetic Construct
tgccttccacagggaggagaa

SEQ ID NO: 38060 - DNA, 23 bp, Artificial Sequence
  Synthetic Construct
ccaggactaagggagttgtctgt

SEQ ID NO: 38061 - DNA, 19 bp, Artificial Sequence
  Synthetic Construct
gcaccaggccaccatcaga

SEQ ID NO: 38062 - DNA, 21 bp, Artificial Sequence
  Synthetic Construct
ggtgcacagcagaggatgtga

SEQ ID NO: 38063 - DNA, 22 bp, Artificial Sequence
  Synthetic Construct
gggtggacatctgtgtgcttgt

SEQ ID NO: 38064 - DNA, 27 bp, Artificial Sequence
  Synthetic Construct
gggattcaagtccacatcttttgattc

SEQ ID NO: 38065 - DNA, 22 bp, Artificial Sequence
  Synthetic Construct
accaagatccactccagcaaaa

SEQ ID NO: 38066 - DNA, 22 bp, Artificial Sequence
  Synthetic Construct
cacagagcccaaagggaagaca

SEQ ID NO: 38067 - DNA, 20 bp, Artificial Sequence
  Synthetic Construct
tgcagtcgatgtggcggtat

SEQ ID NO: 38068 - DNA, 22 bp, Artificial Sequence
  Synthetic Construct
tcagttttgctcacgcttcact

SEQ ID NO: 38069 - DNA, 23 bp, Artificial Sequence
  Synthetic Construct
gctctatgtgctagtgtgtgcat

SEQ ID NO: 38070 - DNA, 23 bp, Artificial Sequence
  Synthetic Construct
gcacagtcagttgtcagggatag

SEQ ID NO: 38071 - DNA, 24 bp, Artificial Sequence
  Synthetic Construct
gcaacacaacacctacaggagaca

SEQ ID NO: 38072 - DNA, 20 bp, Artificial Sequence
  Synthetic Construct
agaggaggctccagcgtgaa

SEQ ID NO: 38073 - DNA, 21 bp, Artificial Sequence
  Synthetic Construct
tctctgggcagctgaggagtt

SEQ ID NO: 38074 - DNA, 20 bp, Artificial Sequence
  Synthetic Construct
cagccacaggcttggaaact

SEQ ID NO: 38075 - DNA, 22 bp, Artificial Sequence
  Synthetic Construct
ggttcctggtgagggaagatgt

SEQ ID NO: 38076 - DNA, 22 bp, Artificial Sequence
  Synthetic Construct
cacccctgacttagctgtggtt

SEQ ID NO: 38077 - DNA, 20 bp, Artificial Sequence
  Synthetic Construct
ttgctcactaccgcctggtt

SEQ ID NO: 38078 - DNA, 23 bp, Artificial Sequence
  Synthetic Construct
tgcatagacaggggaggcctaga

SEQ ID NO: 38079 - DNA, 19 bp, Artificial Sequence
  Synthetic Construct
cgtccacgaagccccagta

SEQ ID NO: 38080 - DNA, 21 bp, Artificial Sequence
  Synthetic Construct
tggccccactacttcctgaac

SEQ ID NO: 38081 - DNA, 22 bp, Artificial Sequence
  Synthetic Construct
gagtgtggcagtcggtactaag

SEQ ID NO: 38082 - DNA, 24 bp, Artificial Sequence
  Synthetic Construct
tctgatggccaagtttttcagaga

SEQ ID NO: 38083 - DNA, 22 bp, Artificial Sequence
  Synthetic Construct
ctccaggaagcatctgttgact

SEQ ID NO: 38084 - DNA, 21 bp, Artificial Sequence
  Synthetic Construct
tggggacttggtgtccactga

SEQ ID NO: 38085 - DNA, 22 bp, Artificial Sequence
  Synthetic Construct
tctggatgacgaagcccctatc

SEQ ID NO: 38086 - DNA, 20 bp, Artificial Sequence
  Synthetic Construct
caagcagctcttggctggaa

SEQ ID NO: 38087 - DNA, 22 bp, Artificial Sequence
  Synthetic Construct
catgttacccagaggccaccta

SEQ ID NO: 38088 - DNA, 22 bp, Artificial Sequence
  Synthetic Construct
ggaggggacaattgctgtgtga

SEQ ID NO: 38089 - DNA, 26 bp, Artificial Sequence
  Synthetic Construct
ccttccctaaagtcccaggagagaag

SEQ ID NO: 38090 - DNA, 21 bp, Artificial Sequence
  Synthetic Construct
tgtgtccagtggctagagctt

SEQ ID NO: 38091 - DNA, 20 bp, Artificial Sequence
  Synthetic Construct
cggatgtgcaggtggaatct

SEQ ID NO: 38092 - DNA, 20 bp, Artificial Sequence
  Synthetic Construct
cccacagagctcgccagaaa

SEQ ID NO: 38093 - DNA, 21 bp, Artificial Sequence
  Synthetic Construct
aggtgactagggcttcccaaa

SEQ ID NO: 38094 - DNA, 24 bp, Artificial Sequence
  Synthetic Construct
caggtttggacttgagtcaacaga

SEQ ID NO: 38095 - DNA, 22 bp, Artificial Sequence
  Synthetic Construct
tggctgaggaggtggatgaatg

SEQ ID NO: 38096 - DNA, 20 bp, Artificial Sequence
  Synthetic Construct
ccgaaggcctctgggcttta

SEQ ID NO: 38097 - DNA, 20 bp, Artificial Sequence
  Synthetic Construct
acatgtgcgtccgtgtcact

SEQ ID NO: 38098 - DNA, 19 bp, Artificial Sequence
  Synthetic Construct
tccagttgcccctcctgaa

SEQ ID NO: 38099 - DNA, 24 bp, Artificial Sequence
  Synthetic Construct
agggatatcatggctggaatgagt

SEQ ID NO: 38100 - DNA, 20 bp, Artificial Sequence
  Synthetic Construct
aggctggcacaggtatgact

SEQ ID NO: 38101 - DNA, 24 bp, Artificial Sequence
  Synthetic Construct
gcgaggctgggcagtatctgatta

SEQ ID NO: 38102 - DNA, 23 bp, Artificial Sequence
  Synthetic Construct
gttgcatcttcatctccctgtct

SEQ ID NO: 38103 - DNA, 20 bp, Artificial Sequence
  Synthetic Construct
tggtggatgcagctggtatg

SEQ ID NO: 38104 - DNA, 23 bp, Artificial Sequence
  Synthetic Construct
ccacagaaacacttctcgctgaa

SEQ ID NO: 38105 - DNA, 23 bp, Artificial Sequence
  Synthetic Construct
gatatgctgagctctgtgctttg

SEQ ID NO: 38106 - DNA, 23 bp, Artificial Sequence
  Synthetic Construct
gactcgatctagccaggaagcat

SEQ ID NO: 38107 - DNA, 19 bp, Artificial Sequence
  Synthetic Construct
tgctgtgtgccactggaaa

SEQ ID NO: 38108 - DNA, 22 bp, Artificial Sequence
  Synthetic Construct
tcaagaggaaaggcgaggacta

SEQ ID NO: 38109 - DNA, 24 bp, Artificial Sequence
  Synthetic Construct
ggcaagaaccctgtgtgtttcttc

SEQ ID NO: 38110 - DNA, 22 bp, Artificial Sequence
  Synthetic Construct
aggcttgacttggggaggacaa

SEQ ID NO: 38111 - DNA, 25 bp, Artificial Sequence
  Synthetic Construct
gctcttctagcttaggcctacattc

SEQ ID NO: 38112 - DNA, 22 bp, Artificial Sequence
  Synthetic Construct
cgcaaacagcagctctgagaaa

SEQ ID NO: 38113 - DNA, 26 bp, Artificial Sequence
  Synthetic Construct
ggtacaaggggtgtaaccataacagt

SEQ ID NO: 38114 - DNA, 23 bp, Artificial Sequence
  Synthetic Construct
gccatcatttcctttcactgctt

SEQ ID NO: 38115 - DNA, 27 bp, Artificial Sequence
  Synthetic Construct
cagaaatagaatgtgaacccaggtagt

SEQ ID NO: 38116 - DNA, 24 bp, Artificial Sequence
  Synthetic Construct
ggacaactagcctggccttagtca

SEQ ID NO: 38117 - DNA, 22 bp, Artificial Sequence
  Synthetic Construct
ctggtcctggaatgttctgtga

SEQ ID NO: 38118 - DNA, 25 bp, Artificial Sequence
  Synthetic Construct
cctggaaaaccaggtgaaccgatct

SEQ ID NO: 38119 - DNA, 20 bp, Artificial Sequence
  Synthetic Construct
cagcccagcacactgacaat

SEQ ID NO: 38120 - DNA, 20 bp, Artificial Sequence
  Synthetic Construct
gcagtggtcctgagccacaa

SEQ ID NO: 38121 - DNA, 21 bp, Artificial Sequence
  Synthetic Construct
tgcctgctacctcctttcagt

SEQ ID NO: 38122 - DNA, 22 bp, Artificial Sequence
  Synthetic Construct
gaactctgggacccttctcaac

SEQ ID NO: 38123 - DNA, 22 bp, Artificial Sequence
  Synthetic Construct
gagagaagagctcctgggaaga

SEQ ID NO: 38124 - DNA, 23 bp, Artificial Sequence
  Synthetic Construct
gggctcaaattctggctccacta

SEQ ID NO: 38125 - DNA, 25 bp, Artificial Sequence
  Synthetic Construct
gtcactgtagtgggagacactgaaa

SEQ ID NO: 38126 - DNA, 21 bp, Artificial Sequence
  Synthetic Construct
tgggcctggcagaacaggaaa

SEQ ID NO: 38127 - DNA, 19 bp, Artificial Sequence
  Synthetic Construct
tggcatgtgccctgtgtca

SEQ ID NO: 38128 - DNA, 21 bp, Artificial Sequence
  Synthetic Construct
aggctgatgcctgtctctttc

SEQ ID NO: 38129 - DNA, 25 bp, Artificial Sequence
  Synthetic Construct
gggaataaccaaccccatggagcat

SEQ ID NO: 38130 - DNA, 20 bp, Artificial Sequence
  Synthetic Construct
gcaggggtgggttgttttga

SEQ ID NO: 38131 - DNA, 19 bp, Artificial Sequence
  Synthetic Construct
gctccacgatgcgctcctt

SEQ ID NO: 38132 - DNA, 25 bp, Artificial Sequence
  Synthetic Construct
ccagttaggtactcctgtggtctga

SEQ ID NO: 38133 - DNA, 23 bp, Artificial Sequence
  Synthetic Construct
gctgaagccctaggtttgccttt

SEQ ID NO: 38134 - DNA, 25 bp, Artificial Sequence
  Synthetic Construct
ggctagcaaacacctacagttgtga

SEQ ID NO: 38135 - DNA, 20 bp, Artificial Sequence
  Synthetic Construct
cccacggttctgcaatcaca

SEQ ID NO: 38136 - DNA, 21 bp, Artificial Sequence
  Synthetic Construct
acatccacttcccagctcctt

SEQ ID NO: 38137 - DNA, 20 bp, Artificial Sequence
  Synthetic Construct
gccctactgcttgtcaccat

SEQ ID NO: 38138 - DNA, 24 bp, Artificial Sequence
  Synthetic Construct
cagctacaaaagcctttggggaat

SEQ ID NO: 38139 - DNA, 22 bp, Artificial Sequence
  Synthetic Construct
cagaaatgcccagtcccctaac

SEQ ID NO: 38140 - DNA, 24 bp, Artificial Sequence
  Synthetic Construct
cggaggcatgattgcaggacattg

SEQ ID NO: 38141 - DNA, 22 bp, Artificial Sequence
  Synthetic Construct
agcagacagagcagtgggtaag

SEQ ID NO: 38142 - DNA, 19 bp, Artificial Sequence
  Synthetic Construct
cctggctggcagcagatca

SEQ ID NO: 38143 - DNA, 20 bp, Artificial Sequence
  Synthetic Construct
tggtgaggggtggagtgttg

SEQ ID NO: 38144 - DNA, 20 bp, Artificial Sequence
  Synthetic Construct
tccaagtctgcagggtgaac

SEQ ID NO: 38145 - DNA, 19 bp, Artificial Sequence
  Synthetic Construct
ttggcctgccaacaacact

SEQ ID NO: 38146 - DNA, 23 bp, Artificial Sequence
  Synthetic Construct
ggacagtgtgggaatggaactca

SEQ ID NO: 38147 - DNA, 22 bp, Artificial Sequence
  Synthetic Construct
cccgcatttacgcgtggatttc

SEQ ID NO: 38148 - DNA, 21 bp, Artificial Sequence
  Synthetic Construct
gtgcagagttcccagtgctat

SEQ ID NO: 38149 - DNA, 18 bp, Artificial Sequence
  Synthetic Construct
tggctccgtcacctctgt

SEQ ID NO: 38150 - DNA, 20 bp, Artificial Sequence
  Synthetic Construct
taccaggacaggcagtgaca

SEQ ID NO: 38151 - DNA, 21 bp, Artificial Sequence
  Synthetic Construct
ccagttccaagcctggcctta

SEQ ID NO: 38152 - DNA, 23 bp, Artificial Sequence
  Synthetic Construct
gtgtgtgtccattctccccttag

SEQ ID NO: 38153 - DNA, 21 bp, Artificial Sequence
  Synthetic Construct
tggtggcaacagacccagact

SEQ ID NO: 38154 - DNA, 26 bp, Artificial Sequence
  Synthetic Construct
ggaacatgcagcagcctcatattttg

SEQ ID NO: 38155 - DNA, 27 bp, Artificial Sequence
  Synthetic Construct
ggaggaaaaataagaaccagacactga

SEQ ID NO: 38156 - DNA, 20 bp, Artificial Sequence
  Synthetic Construct
cgcggaaaaccagtgcagtt

SEQ ID NO: 38157 - DNA, 25 bp, Artificial Sequence
  Synthetic Construct
gctctggagtccttgttctggaaag

SEQ ID NO: 38158 - DNA, 23 bp, Artificial Sequence
  Synthetic Construct
gctatttgatggcattgctcctt

SEQ ID NO: 38159 - DNA, 24 bp, Artificial Sequence
  Synthetic Construct
tcaataatcaggctctgggaggaa

SEQ ID NO: 38160 - DNA, 21 bp, Artificial Sequence
  Synthetic Construct
agaccatccaggggctagtgt

SEQ ID NO: 38161 - DNA, 20 bp, Artificial Sequence
  Synthetic Construct
gtgtgttggggacacagcaa

SEQ ID NO: 38162 - DNA, 29 bp, Artificial Sequence
  Synthetic Construct
ggctttttaacaggtagaactggtgtgtt

SEQ ID NO: 38163 - DNA, 26 bp, Artificial Sequence
  Synthetic Construct
ctctgtatctggtcttgtcaggagtt

SEQ ID NO: 38164 - DNA, 22 bp, Artificial Sequence
  Synthetic Construct
gctcccgtggtcatctgtgttt

SEQ ID NO: 38165 - DNA, 21 bp, Artificial Sequence
  Synthetic Construct
tacccctggcggctgcttgta

SEQ ID NO: 38166 - DNA, 24 bp, Artificial Sequence
  Synthetic Construct
ggtcagggtaggaggtcaatgtca

SEQ ID NO: 38167 - DNA, 25 bp, Artificial Sequence
  Synthetic Construct
ccatgttcccctttggactagagtt

SEQ ID NO: 38168 - DNA, 20 bp, Artificial Sequence
  Synthetic Construct
cctccgtgaccccagaaaga

SEQ ID NO: 38169 - DNA, 26 bp, Artificial Sequence
  Synthetic Construct
cccaccagatttcttccttcctgaga

SEQ ID NO: 38170 - DNA, 20 bp, Artificial Sequence
  Synthetic Construct
cagcttgtcgctggagcaat

SEQ ID NO: 38171 - DNA, 21 bp, Artificial Sequence
  Synthetic Construct
cccagccccaggtttacaaca

SEQ ID NO: 38172 - DNA, 26 bp, Artificial Sequence
  Synthetic Construct
gctggagtttcaattggcatggaagt

SEQ ID NO: 38173 - DNA, 21 bp, Artificial Sequence
  Synthetic Construct
ggctttggcagcagtgataag

SEQ ID NO: 38174 - DNA, 21 bp, Artificial Sequence
  Synthetic Construct
aggagacgtgggtctgaaaca

SEQ ID NO: 38175 - DNA, 26 bp, Artificial Sequence
  Synthetic Construct
gaccagcctacatttatcaggcaatg

SEQ ID NO: 38176 - DNA, 20 bp, Artificial Sequence
  Synthetic Construct
cctgtcagcccctccttcat

SEQ ID NO: 38177 - DNA, 23 bp, Artificial Sequence
  Synthetic Construct
gggccaggcagattcagagattg

SEQ ID NO: 38178 - DNA, 23 bp, Artificial Sequence
  Synthetic Construct
gaccaagttgccatcatctcttg

SEQ ID NO: 38179 - DNA, 22 bp, Artificial Sequence
  Synthetic Construct
accctccaggcactagaagtga

SEQ ID NO: 38180 - DNA, 20 bp, Artificial Sequence
  Synthetic Construct
acccgacagctcaggtcaat

SEQ ID NO: 38181 - DNA, 18 bp, Artificial Sequence
  Synthetic Construct
tgcgccctgcctctaaac

SEQ ID NO: 38182 - DNA, 22 bp, Artificial Sequence
  Synthetic Construct
cctctctgtaatgccccactgt

SEQ ID NO: 38183 - DNA, 20 bp, Artificial Sequence
  Synthetic Construct
ggttgcctcttgccagttca

SEQ ID NO: 38184 - DNA, 22 bp, Artificial Sequence
  Synthetic Construct
cagggaggagcaacacagttca

SEQ ID NO: 38185 - DNA, 21 bp, Artificial Sequence
  Synthetic Construct
tcaaccactgtcggtcaggat

SEQ ID NO: 38186 - DNA, 20 bp, Artificial Sequence
  Synthetic Construct
ttcacgccactggtctctca

SEQ ID NO: 38187 - DNA, 23 bp, Artificial Sequence
  Synthetic Construct
atcacctaaagcagcatgcaaag

SEQ ID NO: 38188 - DNA, 20 bp, Artificial Sequence
  Synthetic Construct
aagtcatggggcagggagat

SEQ ID NO: 38189 - DNA, 21 bp, Artificial Sequence
  Synthetic Construct
tccaagccaaacgatgactga

SEQ ID NO: 38190 - DNA, 18 bp, Artificial Sequence
  Synthetic Construct
ttgccccaagcagcatca

SEQ ID NO: 38191 - DNA, 26 bp, Artificial Sequence
  Synthetic Construct
gaggcatctataccgtgaagaacttg

SEQ ID NO: 38192 - DNA, 23 bp, Artificial Sequence
  Synthetic Construct
cctgcacacagtctgttggatag

SEQ ID NO: 38193 - DNA, 24 bp, Artificial Sequence
  Synthetic Construct
gccaagcatggaaaccatttgact

SEQ ID NO: 38194 - DNA, 21 bp, Artificial Sequence
  Synthetic Construct
cgtgggagtcgatgacaccat

SEQ ID NO: 38195 - DNA, 22 bp, Artificial Sequence
  Synthetic Construct
ccccagaccagcatacttgtga

SEQ ID NO: 38196 - DNA, 27 bp, Artificial Sequence
  Synthetic Construct
gggctcaccatggatcattatctgtat

SEQ ID NO: 38197 - DNA, 21 bp, Artificial Sequence
  Synthetic Construct
gagggaaagtgacctgtgcaa

SEQ ID NO: 38198 - DNA, 24 bp, Artificial Sequence
  Synthetic Construct
gtctgactgcagagcttgtacttg

SEQ ID NO: 38199 - DNA, 24 bp, Artificial Sequence
  Synthetic Construct
cacttcccaagctaaaggggttga

SEQ ID NO: 38200 - DNA, 19 bp, Artificial Sequence
  Synthetic Construct
agccagcatctgcaactgt

SEQ ID NO: 38201 - DNA, 23 bp, Artificial Sequence
  Synthetic Construct
aagggctttaaccagcctagaag

SEQ ID NO: 38202 - DNA, 22 bp, Artificial Sequence
  Synthetic Construct
cacagtgcacagaaagcacttg

SEQ ID NO: 38203 - DNA, 22 bp, Artificial Sequence
  Synthetic Construct
ttgagaccaaccctgccctttg

SEQ ID NO: 38204 - DNA, 22 bp, Artificial Sequence
  Synthetic Construct
cggctcttcactgctctactgt

SEQ ID NO: 38205 - DNA, 22 bp, Artificial Sequence
  Synthetic Construct
ggaacacacagcctcagagcat

SEQ ID NO: 38206 - DNA, 23 bp, Artificial Sequence
  Synthetic Construct
ctccaaagaacactgcccagtaa

SEQ ID NO: 38207 - DNA, 24 bp, Artificial Sequence
  Synthetic Construct
gcttcctgtaatgggtctaaggtt

SEQ ID NO: 38208 - DNA, 30 bp, Artificial Sequence
  Synthetic Construct
gcaaggaagtaattagatcactggggtgta

SEQ ID NO: 38209 - DNA, 23 bp, Artificial Sequence
  Synthetic Construct
gtgggttgttgtaaagccacgat

SEQ ID NO: 38210 - DNA, 22 bp, Artificial Sequence
  Synthetic Construct
cgaacccacacttctcttctga

SEQ ID NO: 38211 - DNA, 23 bp, Artificial Sequence
  Synthetic Construct
gaatcagaatgggagaggcgtat

SEQ ID NO: 38212 - DNA, 22 bp, Artificial Sequence
  Synthetic Construct
cggccttagccatgggaaatca

SEQ ID NO: 38213 - DNA, 24 bp, Artificial Sequence
  Synthetic Construct
gtggggagacctgctatcttctac

SEQ ID NO: 38214 - DNA, 23 bp, Artificial Sequence
  Synthetic Construct
gccaggatggtggatgatggtaa

SEQ ID NO: 38215 - DNA, 23 bp, Artificial Sequence
  Synthetic Construct
cctctttggtgactcagggattc

SEQ ID NO: 38216 - DNA, 22 bp, Artificial Sequence
  Synthetic Construct
ggcttcaagagcttccctgttg

SEQ ID NO: 38217 - DNA, 21 bp, Artificial Sequence
  Synthetic Construct
gaccttgctgaacggttcctt

SEQ ID NO: 38218 - DNA, 22 bp, Artificial Sequence
  Synthetic Construct
tggaaacgggtgtgagagtttg

SEQ ID NO: 38219 - DNA, 24 bp, Artificial Sequence
  Synthetic Construct
aggcagaattgacgttcatcctat

SEQ ID NO: 38220 - DNA, 23 bp, Artificial Sequence
  Synthetic Construct
gtggttcacagcgtgatctgact

SEQ ID NO: 38221 - DNA, 21 bp, Artificial Sequence
  Synthetic Construct
gcagagcgaggtcacctttga

SEQ ID NO: 38222 - DNA, 20 bp, Artificial Sequence
  Synthetic Construct
tcagtgggctggatggtagt

SEQ ID NO: 38223 - DNA, 20 bp, Artificial Sequence
  Synthetic Construct
aggccaaatcctggctcaag

SEQ ID NO: 38224 - DNA, 21 bp, Artificial Sequence
  Synthetic Construct
tgttgctgtctggcaagatgt

SEQ ID NO: 38225 - DNA, 20 bp, Artificial Sequence
  Synthetic Construct
tggcttggggcagggaggta

SEQ ID NO: 38226 - DNA, 27 bp, Artificial Sequence
  Synthetic Construct
ctaattgtgttccatacctccactact

SEQ ID NO: 38227 - DNA, 24 bp, Artificial Sequence
  Synthetic Construct
agtgcagagagcaaatttcaggat

SEQ ID NO: 38228 - DNA, 20 bp, Artificial Sequence
  Synthetic Construct
aaggcctgacttggccattg

SEQ ID NO: 38229 - DNA, 23 bp, Artificial Sequence
  Synthetic Construct
tctttgttcaaaacgcccagaac

SEQ ID NO: 38230 - DNA, 22 bp, Artificial Sequence
  Synthetic Construct
cacaatctcagcccctggcttt

SEQ ID NO: 38231 - DNA, 20 bp, Artificial Sequence
  Synthetic Construct
cccaaggtgccaagctcatt

SEQ ID NO: 38232 - DNA, 25 bp, Artificial Sequence
  Synthetic Construct
tgatgacagaggagtaaaggtctct

SEQ ID NO: 38233 - DNA, 23 bp, Artificial Sequence
  Synthetic Construct
ggtgcatgcaaagagtgggatag

SEQ ID NO: 38234 - DNA, 22 bp, Artificial Sequence
  Synthetic Construct
ctcagcccttccaccttcttct

SEQ ID NO: 38235 - DNA, 21 bp, Artificial Sequence
  Synthetic Construct
cccatcccgaatcccaccttt

SEQ ID NO: 38236 - DNA, 23 bp, Artificial Sequence
  Synthetic Construct
tgggagtacctggatccccttag

SEQ ID NO: 38237 - DNA, 22 bp, Artificial Sequence
  Synthetic Construct
ggcacacgatgaaagggataga

SEQ ID NO: 38238 - DNA, 22 bp, Artificial Sequence
  Synthetic Construct
aggaccacagcagcttcgattc

SEQ ID NO: 38239 - DNA, 22 bp, Artificial Sequence
  Synthetic Construct
gtccagaaggcaggaaccatac

SEQ ID NO: 38240 - DNA, 20 bp, Artificial Sequence
  Synthetic Construct
tcagggtgccctagctccat

SEQ ID NO: 38241 - DNA, 20 bp, Artificial Sequence
  Synthetic Construct
cccaaccacagcagcctttg

SEQ ID NO: 38242 - DNA, 22 bp, Artificial Sequence
  Synthetic Construct
aggttccctgccttagggatga

SEQ ID NO: 38243 - DNA, 22 bp, Artificial Sequence
  Synthetic Construct
aatcctccctcccctgcatcta

SEQ ID NO: 38244 - DNA, 28 bp, Artificial Sequence
  Synthetic Construct
ccatcctatatgtcaggtgcaagacaac

SEQ ID NO: 38245 - DNA, 23 bp, Artificial Sequence
  Synthetic Construct
ggaggtagcagcatttacctgtt

SEQ ID NO: 38246 - DNA, 19 bp, Artificial Sequence
  Synthetic Construct
tctccagccgagggtctca

SEQ ID NO: 38247 - DNA, 28 bp, Artificial Sequence
  Synthetic Construct
gggagtgtaattcagggagtgtaattct

SEQ ID NO: 38248 - DNA, 22 bp, Artificial Sequence
  Synthetic Construct
tggtcagctccggctctaaatc

SEQ ID NO: 38249 - DNA, 23 bp, Artificial Sequence
  Synthetic Construct
taccgtcctccctgctaggaaca

SEQ ID NO: 38250 - DNA, 26 bp, Artificial Sequence
  Synthetic Construct
ccactgcagtttacagtgtgaagcat

SEQ ID NO: 38251 - DNA, 22 bp, Artificial Sequence
  Synthetic Construct
gcctggggaatgctactgattg

SEQ ID NO: 38252 - DNA, 24 bp, Artificial Sequence
  Synthetic Construct
ggacaaggactgtgtagagagaac

SEQ ID NO: 38253 - DNA, 21 bp, Artificial Sequence
  Synthetic Construct
tgtggtgtccagcccttcact

SEQ ID NO: 38254 - DNA, 21 bp, Artificial Sequence
  Synthetic Construct
gtgtgtccgagcacattgttg

SEQ ID NO: 38255 - DNA, 22 bp, Artificial Sequence
  Synthetic Construct
ggggcacgtggagtttctcatt

SEQ ID NO: 38256 - DNA, 24 bp, Artificial Sequence
  Synthetic Construct
tgtagtgatggtgtttgtgacctt

SEQ ID NO: 38257 - DNA, 22 bp, Artificial Sequence
  Synthetic Construct
ggagggcacaaaactgccttct

SEQ ID NO: 38258 - DNA, 20 bp, Artificial Sequence
  Synthetic Construct
ttagcaggaggtgggtgagt

SEQ ID NO: 38259 - DNA, 20 bp, Artificial Sequence
  Synthetic Construct
aactggaggtggggatggaa

SEQ ID NO: 38260 - DNA, 22 bp, Artificial Sequence
  Synthetic Construct
atgctacccctggccctctgta

SEQ ID NO: 38261 - DNA, 19 bp, Artificial Sequence
  Synthetic Construct
tccctctggccctgtggtt

SEQ ID NO: 38262 - DNA, 20 bp, Artificial Sequence
  Synthetic Construct
gctgcatcttcacgcctaca

SEQ ID NO: 38263 - DNA, 26 bp, Artificial Sequence
  Synthetic Construct
gcccagttttagggaccaaagaccat

SEQ ID NO: 38264 - DNA, 27 bp, Artificial Sequence
  Synthetic Construct
gagttggtctccagagaatacttcctt

SEQ ID NO: 38265 - DNA, 20 bp, Artificial Sequence
  Synthetic Construct
acctccagagcccacactct

SEQ ID NO: 38266 - DNA, 23 bp, Artificial Sequence
  Synthetic Construct
gggagacttcgttgtgggacaag

SEQ ID NO: 38267 - DNA, 22 bp, Artificial Sequence
  Synthetic Construct
ccggcccctttaaggaagaagt

SEQ ID NO: 38268 - DNA, 24 bp, Artificial Sequence
  Synthetic Construct
gggaacaggtgtcctttccaggtt

SEQ ID NO: 38269 - DNA, 22 bp, Artificial Sequence
  Synthetic Construct
ccagcaacttaggctggactca

SEQ ID NO: 38270 - DNA, 25 bp, Artificial Sequence
  Synthetic Construct
cctccttatgccactgtgtcccaat

SEQ ID NO: 38271 - DNA, 21 bp, Artificial Sequence
  Synthetic Construct
tccgaggcaggcaactctaca

SEQ ID NO: 38272 - DNA, 30 bp, Artificial Sequence
  Synthetic Construct
gactccataataaaagtgggtggtttgcta

SEQ ID NO: 38273 - DNA, 19 bp, Artificial Sequence
  Synthetic Construct
gaggagctgcccacaccta

SEQ ID NO: 38274 - DNA, 20 bp, Artificial Sequence
  Synthetic Construct
agctcccgctggctctgtct

SEQ ID NO: 38275 - DNA, 20 bp, Artificial Sequence
  Synthetic Construct
ggaggcagcaccctttttga

SEQ ID NO: 38276 - DNA, 22 bp, Artificial Sequence
  Synthetic Construct
tgtctccctgttcccagtgtca

SEQ ID NO: 38277 - DNA, 19 bp, Artificial Sequence
  Synthetic Construct
caacacccctcccctgagt

SEQ ID NO: 38278 - DNA, 23 bp, Artificial Sequence
  Synthetic Construct
gggacagatgggatgaaaacaca

SEQ ID NO: 38279 - DNA, 24 bp, Artificial Sequence
  Synthetic Construct
tcagaggatgaaggggacattttc

SEQ ID NO: 38280 - DNA, 20 bp, Artificial Sequence
  Synthetic Construct
gggtcctgtgtgggaacctt

SEQ ID NO: 38281 - DNA, 20 bp, Artificial Sequence
  Synthetic Construct
cgcatttggtggctctctgt

SEQ ID NO: 38282 - DNA, 23 bp, Artificial Sequence
  Synthetic Construct
cctaaatgcatgggaggcaggaa

SEQ ID NO: 38283 - DNA, 25 bp, Artificial Sequence
  Synthetic Construct
agtacaatggatctgtcgtttggaa

SEQ ID NO: 38284 - DNA, 22 bp, Artificial Sequence
  Synthetic Construct
gcctccactccagaaagagaga

SEQ ID NO: 38285 - DNA, 19 bp, Artificial Sequence
  Synthetic Construct
ccaccacctctgggcaaca

SEQ ID NO: 38286 - DNA, 20 bp, Artificial Sequence
  Synthetic Construct
tctctggggcagctgaagtt

SEQ ID NO: 38287 - DNA, 20 bp, Artificial Sequence
  Synthetic Construct
cccaaagtgctgggccatag

SEQ ID NO: 38288 - DNA, 25 bp, Artificial Sequence
  Synthetic Construct
ccttttgagaaccagctcaaatgtt

SEQ ID NO: 38289 - DNA, 23 bp, Artificial Sequence
  Synthetic Construct
agagaggactttgggaacacaga

SEQ ID NO: 38290 - DNA, 20 bp, Artificial Sequence
  Synthetic Construct
tctgtctggaagcgggtgaa

SEQ ID NO: 38291 - DNA, 22 bp, Artificial Sequence
  Synthetic Construct
cacatcaaagccctgctgtagt

SEQ ID NO: 38292 - DNA, 26 bp, Artificial Sequence
  Synthetic Construct
ctggggcaaaagactgattttcttca

SEQ ID NO: 38293 - DNA, 20 bp, Artificial Sequence
  Synthetic Construct
gcaccttggggtgtgcttgt

SEQ ID NO: 38294 - DNA, 22 bp, Artificial Sequence
  Synthetic Construct
ggcagacgccactttctactca

SEQ ID NO: 38295 - DNA, 20 bp, Artificial Sequence
  Synthetic Construct
ttgggacgggtctcccactt

SEQ ID NO: 38296 - DNA, 22 bp, Artificial Sequence
  Synthetic Construct
acagaaagccctgcagctctac

SEQ ID NO: 38297 - DNA, 22 bp, Artificial Sequence
  Synthetic Construct
gcatgccccaaggtagacagtt

SEQ ID NO: 38298 - DNA, 21 bp, Artificial Sequence
  Synthetic Construct
gtgcatggtggttccaagtga

SEQ ID NO: 38299 - DNA, 23 bp, Artificial Sequence
  Synthetic Construct
ggtttcatgactccctggtccaa

SEQ ID NO: 38300 - DNA, 18 bp, Artificial Sequence
  Synthetic Construct
tgagccaggcaggtgcta

SEQ ID NO: 38301 - DNA, 21 bp, Artificial Sequence
  Synthetic Construct
ttgccccagaatcacacaagt

SEQ ID NO: 38302 - DNA, 23 bp, Artificial Sequence
  Synthetic Construct
gtccccacacatcctctttgttg

SEQ ID NO: 38303 - DNA, 19 bp, Artificial Sequence
  Synthetic Construct
cctccccagccccaaacta

SEQ ID NO: 38304 - DNA, 24 bp, Artificial Sequence
  Synthetic Construct
agagataggaccacacaccattga

SEQ ID NO: 38305 - DNA, 20 bp, Artificial Sequence
  Synthetic Construct
tggtggggtcagtggttaga

SEQ ID NO: 38306 - DNA, 19 bp, Artificial Sequence
  Synthetic Construct
gcagcgagtcctccgtgta

SEQ ID NO: 38307 - DNA, 19 bp, Artificial Sequence
  Synthetic Construct
caggcccagtgggaagttg

SEQ ID NO: 38308 - DNA, 24 bp, Artificial Sequence
  Synthetic Construct
caccaggactagcactagaaggaa

SEQ ID NO: 38309 - DNA, 21 bp, Artificial Sequence
  Synthetic Construct
tcaccccagcctgacacttct

SEQ ID NO: 38310 - DNA, 22 bp, Artificial Sequence
  Synthetic Construct
gacgacgcacaacatcttgcat

SEQ ID NO: 38311 - DNA, 24 bp, Artificial Sequence
  Synthetic Construct
ccacctatgtgccaggaagctttg

SEQ ID NO: 38312 - DNA, 21 bp, Artificial Sequence
  Synthetic Construct
gggattgtcccaaagcggaaa

SEQ ID NO: 38313 - DNA, 25 bp, Artificial Sequence
  Synthetic Construct
ttccctgcattgttactactcagtt

SEQ ID NO: 38314 - DNA, 20 bp, Artificial Sequence
  Synthetic Construct
ggcatggcagtgagaagcat

SEQ ID NO: 38315 - DNA, 20 bp, Artificial Sequence
  Synthetic Construct
agccaacaccaccggaagat

SEQ ID NO: 38316 - DNA, 23 bp, Artificial Sequence
  Synthetic Construct
gcagtcctgtcctcttggtcttc

SEQ ID NO: 38317 - DNA, 22 bp, Artificial Sequence
  Synthetic Construct
gccaaggccgaggtgctaaaaa

SEQ ID NO: 38318 - DNA, 20 bp, Artificial Sequence
  Synthetic Construct
accaccccgcttgaaaccta

SEQ ID NO: 38319 - DNA, 22 bp, Artificial Sequence
  Synthetic Construct
ggggtgaattccagctctgaca

SEQ ID NO: 38320 - DNA, 22 bp, Artificial Sequence
  Synthetic Construct
gcaaactgaggctggacgactt

SEQ ID NO: 38321 - DNA, 23 bp, Artificial Sequence
  Synthetic Construct
ccctcaagcatggatgcacagtt

SEQ ID NO: 38322 - DNA, 24 bp, Artificial Sequence
  Synthetic Construct
gccccacctatcagccagacttta

SEQ ID NO: 38323 - DNA, 19 bp, Artificial Sequence
  Synthetic Construct
tggtctccaccgtgctttg

SEQ ID NO: 38324 - DNA, 19 bp, Artificial Sequence
  Synthetic Construct
tgtctgccagcgctgttgt

SEQ ID NO: 38325 - DNA, 21 bp, Artificial Sequence
  Synthetic Construct
caaccatgtccccaacccttt

SEQ ID NO: 38326 - DNA, 22 bp, Artificial Sequence
  Synthetic Construct
gaggccacactctcagattcaa

SEQ ID NO: 38327 - DNA, 22 bp, Artificial Sequence
  Synthetic Construct
gttggcctcaaacaccttcact

SEQ ID NO: 38328 - DNA, 23 bp, Artificial Sequence
  Synthetic Construct
gagtcacgccacctaatccattc

SEQ ID NO: 38329 - DNA, 18 bp, Artificial Sequence
  Synthetic Construct
agcccgtctccccatgtt

SEQ ID NO: 38330 - DNA, 24 bp, Artificial Sequence
  Synthetic Construct
cccctctaggaagtcctgctttca

SEQ ID NO: 38331 - DNA, 22 bp, Artificial Sequence
  Synthetic Construct
cgcatgcaagagactggttttg

SEQ ID NO: 38332 - DNA, 20 bp, Artificial Sequence
  Synthetic Construct
ggacctgaaggccccaatct

SEQ ID NO: 38333 - DNA, 25 bp, Artificial Sequence
  Synthetic Construct
ccaagggaactaacttctggctagt

SEQ ID NO: 38334 - DNA, 23 bp, Artificial Sequence
  Synthetic Construct
gcagagctcaggtctcaccaatg

SEQ ID NO: 38335 - DNA, 24 bp, Artificial Sequence
  Synthetic Construct
ctgctgaaggttagcctcctctta

SEQ ID NO: 38336 - DNA, 22 bp, Artificial Sequence
  Synthetic Construct
ggaagtcaaacggccaaacgaa

SEQ ID NO: 38337 - DNA, 24 bp, Artificial Sequence
  Synthetic Construct
cccgcacagtttaaacattcatct

SEQ ID NO: 38338 - DNA, 23 bp, Artificial Sequence
  Synthetic Construct
gccctgtgcactgatgagacaaa

SEQ ID NO: 38339 - DNA, 19 bp, Artificial Sequence
  Synthetic Construct
tgcccctggcgggatacat

SEQ ID NO: 38340 - DNA, 22 bp, Artificial Sequence
  Synthetic Construct
caggagaggaaaactgctgact

SEQ ID NO: 38341 - DNA, 22 bp, Artificial Sequence
  Synthetic Construct
gacagagtgagacacccacttc

SEQ ID NO: 38342 - DNA, 22 bp, Artificial Sequence
  Synthetic Construct
tcgaaggctacctctgccatca

SEQ ID NO: 38343 - DNA, 25 bp, Artificial Sequence
  Synthetic Construct
tgtgatgacgagtaagtgaggaaga

SEQ ID NO: 38344 - DNA, 22 bp, Artificial Sequence
  Synthetic Construct
gcctaaccttggccttgacaca

SEQ ID NO: 38345 - DNA, 20 bp, Artificial Sequence
  Synthetic Construct
gcctgggaatcatggcaact

SEQ ID NO: 38346 - DNA, 21 bp, Artificial Sequence
  Synthetic Construct
gccgcccttgacccattgtat

SEQ ID NO: 38347 - DNA, 25 bp, Artificial Sequence
  Synthetic Construct
ggcgtatgaattggagtcagtaagt

SEQ ID NO: 38348 - DNA, 24 bp, Artificial Sequence
  Synthetic Construct
caggcaccaagtacattcatcagt

SEQ ID NO: 38349 - DNA, 22 bp, Artificial Sequence
  Synthetic Construct
gcatgcagtatgaggggtctac

SEQ ID NO: 38350 - DNA, 20 bp, Artificial Sequence
  Synthetic Construct
tggaaggggcacacaacact

SEQ ID NO: 38351 - DNA, 22 bp, Artificial Sequence
  Synthetic Construct
gctcccatcagtgccaagcaat

SEQ ID NO: 38352 - DNA, 18 bp, Artificial Sequence
  Synthetic Construct
tgggaggctctgcactga

SEQ ID NO: 38353 - DNA, 19 bp, Artificial Sequence
  Synthetic Construct
cgcacacagtgcctgacat

SEQ ID NO: 38354 - DNA, 23 bp, Artificial Sequence
  Synthetic Construct
gccccgtaactgtactggtgaga

SEQ ID NO: 38355 - DNA, 25 bp, Artificial Sequence
  Synthetic Construct
cctccccactattcaagtcccaact

SEQ ID NO: 38356 - DNA, 24 bp, Artificial Sequence
  Synthetic Construct
agcaactaagaaggttccttgaca

SEQ ID NO: 38357 - DNA, 22 bp, Artificial Sequence
  Synthetic Construct
tgctgctccctctgtgtctttc

SEQ ID NO: 38358 - DNA, 27 bp, Artificial Sequence
  Synthetic Construct
ctgaatggaactgaagttaccctgaat

SEQ ID NO: 38359 - DNA, 21 bp, Artificial Sequence
  Synthetic Construct
gaaagcacagatgccccaaag

SEQ ID NO: 38360 - DNA, 19 bp, Artificial Sequence
  Synthetic Construct
ttctctggggccggactga

SEQ ID NO: 38361 - DNA, 21 bp, Artificial Sequence
  Synthetic Construct
cctggtgggatgcctacgttt

SEQ ID NO: 38362 - DNA, 21 bp, Artificial Sequence
  Synthetic Construct
tcggtaggtaggcgtcctaga

SEQ ID NO: 38363 - DNA, 20 bp, Artificial Sequence
  Synthetic Construct
tggcagagctgctggaattg

SEQ ID NO: 38364 - DNA, 21 bp, Artificial Sequence
  Synthetic Construct
gggtgtcttctggtggtcatc

SEQ ID NO: 38365 - DNA, 20 bp, Artificial Sequence
  Synthetic Construct
cgcaggttctcgatgcttgt

SEQ ID NO: 38366 - DNA, 22 bp, Artificial Sequence
  Synthetic Construct
ggtgttttccacttcgggagtt

SEQ ID NO: 38367 - DNA, 23 bp, Artificial Sequence
  Synthetic Construct
gaactttcccatggcttccaaac

SEQ ID NO: 38368 - DNA, 24 bp, Artificial Sequence
  Synthetic Construct
ccgagatctggacttgtgtctatc

SEQ ID NO: 38369 - DNA, 20 bp, Artificial Sequence
  Synthetic Construct
ggaaaggatggggccaggaa

SEQ ID NO: 38370 - DNA, 25 bp, Artificial Sequence
  Synthetic Construct
ccaatgctatgtcgtgtttgattga

SEQ ID NO: 38371 - DNA, 22 bp, Artificial Sequence
  Synthetic Construct
cagctgctaagggaccaagtca

SEQ ID NO: 38372 - DNA, 28 bp, Artificial Sequence
  Synthetic Construct
ggacagctaaatcagagagctatggaaa

SEQ ID NO: 38373 - DNA, 23 bp, Artificial Sequence
  Synthetic Construct
acagtgaatcagcactcctcaga

SEQ ID NO: 38374 - DNA, 25 bp, Artificial Sequence
  Synthetic Construct
actgataccatcttctggaggactt

SEQ ID NO: 38375 - DNA, 22 bp, Artificial Sequence
  Synthetic Construct
ggggtccttactccctttcttg

SEQ ID NO: 38376 - DNA, 19 bp, Artificial Sequence
  Synthetic Construct
aaggggcaaggtgctgaag

SEQ ID NO: 38377 - DNA, 26 bp, Artificial Sequence
  Synthetic Construct
ccattaatccagcagttccttgatac

SEQ ID NO: 38378 - DNA, 20 bp, Artificial Sequence
  Synthetic Construct
tcccagtcagccccttgaga

SEQ ID NO: 38379 - DNA, 22 bp, Artificial Sequence
  Synthetic Construct
tcacctgtcactccgtgtgtag

SEQ ID NO: 38380 - DNA, 25 bp, Artificial Sequence
  Synthetic Construct
tcaatgacatcctagagccactttg

SEQ ID NO: 38381 - DNA, 19 bp, Artificial Sequence
  Synthetic Construct
ggctttgggcctggtggtt

SEQ ID NO: 38382 - DNA, 23 bp, Artificial Sequence
  Synthetic Construct
cccttgcccatctcagttacaag

SEQ ID NO: 38383 - DNA, 22 bp, Artificial Sequence
  Synthetic Construct
cctgcccattcaaccccatctt

SEQ ID NO: 38384 - DNA, 24 bp, Artificial Sequence
  Synthetic Construct
gctcagagagccactgaaggctta

SEQ ID NO: 38385 - DNA, 20 bp, Artificial Sequence
  Synthetic Construct
gtgcccgggataggagactt

SEQ ID NO: 38386 - DNA, 20 bp, Artificial Sequence
  Synthetic Construct
ggcagcagagaccaccagtt

SEQ ID NO: 38387 - DNA, 20 bp, Artificial Sequence
  Synthetic Construct
tggaggtcacctgctgtgaa

SEQ ID NO: 38388 - DNA, 28 bp, Artificial Sequence
  Synthetic Construct
gtgggtgttttaggccttgtaattctac

SEQ ID NO: 38389 - DNA, 22 bp, Artificial Sequence
  Synthetic Construct
gctcggctccaacgtgtcaata

SEQ ID NO: 38390 - DNA, 20 bp, Artificial Sequence
  Synthetic Construct
agtgggacagcagggaaaga

SEQ ID NO: 38391 - DNA, 26 bp, Artificial Sequence
  Synthetic Construct
ggagactcatgtcaaatgtcctgtca

SEQ ID NO: 38392 - DNA, 21 bp, Artificial Sequence
  Synthetic Construct
ggccctatgcaggtggtttct

SEQ ID NO: 38393 - DNA, 21 bp, Artificial Sequence
  Synthetic Construct
cttcccaagttgctgcactct

SEQ ID NO: 38394 - DNA, 22 bp, Artificial Sequence
  Synthetic Construct
cctgagacccaggcatgttagt

SEQ ID NO: 38395 - DNA, 22 bp, Artificial Sequence
  Synthetic Construct
ccaccaggctcacaaattcact

SEQ ID NO: 38396 - DNA, 24 bp, Artificial Sequence
  Synthetic Construct
gagaggaggacagaagtctgaaag

SEQ ID NO: 38397 - DNA, 20 bp, Artificial Sequence
  Synthetic Construct
ttggggaggtgggcttttca

SEQ ID NO: 38398 - DNA, 20 bp, Artificial Sequence
  Synthetic Construct
gcctcactgggcccgatttt

SEQ ID NO: 38399 - DNA, 22 bp, Artificial Sequence
  Synthetic Construct
cgagctttggatgctccctttc

SEQ ID NO: 38400 - DNA, 30 bp, Artificial Sequence
  Synthetic Construct
gcctattttccttttgagggaatgcatctt

SEQ ID NO: 38401 - DNA, 26 bp, Artificial Sequence
  Synthetic Construct
ccgactggcatgctgacagaatctaa

SEQ ID NO: 38402 - DNA, 28 bp, Artificial Sequence
  Synthetic Construct
gcaaatctgtttgatatggagccgaaag

SEQ ID NO: 38403 - DNA, 20 bp, Artificial Sequence
  Synthetic Construct
tctagcttggggcactggaa

SEQ ID NO: 38404 - DNA, 21 bp, Artificial Sequence
  Synthetic Construct
acatccttaggggccctttgt

SEQ ID NO: 38405 - DNA, 21 bp, Artificial Sequence
  Synthetic Construct
ggtgtgggccagacaatgtga

SEQ ID NO: 38406 - DNA, 22 bp, Artificial Sequence
  Synthetic Construct
ccagagtggctgaagcacagat

SEQ ID NO: 38407 - DNA, 23 bp, Artificial Sequence
  Synthetic Construct
agacttagagctgcgagacaaaa

SEQ ID NO: 38408 - DNA, 21 bp, Artificial Sequence
  Synthetic Construct
ccagtgtcatgtggccgagta

SEQ ID NO: 38409 - DNA, 22 bp, Artificial Sequence
  Synthetic Construct
ggaaaccatgccaggctctttg

SEQ ID NO: 38410 - DNA, 25 bp, Artificial Sequence
  Synthetic Construct
cccagcatcagctgctcatatgtaa

SEQ ID NO: 38411 - DNA, 26 bp, Artificial Sequence
  Synthetic Construct
gttcctaaaaggatcatgcagagaga

SEQ ID NO: 38412 - DNA, 21 bp, Artificial Sequence
  Synthetic Construct
tggtggcaactagggatgtga

SEQ ID NO: 38413 - DNA, 24 bp, Artificial Sequence
  Synthetic Construct
gtggacaaagtactcactccttct

SEQ ID NO: 38414 - DNA, 23 bp, Artificial Sequence
  Synthetic Construct
ccacatgaccctaagacggtaga

SEQ ID NO: 38415 - DNA, 25 bp, Artificial Sequence
  Synthetic Construct
ccttgcaggaaggtttatcttttgt

SEQ ID NO: 38416 - DNA, 20 bp, Artificial Sequence
  Synthetic Construct
caagggcctggcttctttgt

SEQ ID NO: 38417 - DNA, 22 bp, Artificial Sequence
  Synthetic Construct
ctgggcggagagacactaaatg

SEQ ID NO: 38418 - DNA, 19 bp, Artificial Sequence
  Synthetic Construct
atcaggggctggtccaaca

SEQ ID NO: 38419 - DNA, 23 bp, Artificial Sequence
  Synthetic Construct
cgaacgctacacctaggacattg

SEQ ID NO: 38420 - DNA, 23 bp, Artificial Sequence
  Synthetic Construct
gaaggcaaaagtagtggggatct

SEQ ID NO: 38421 - DNA, 18 bp, Artificial Sequence
  Synthetic Construct
tgcctgcacctccaccat

SEQ ID NO: 38422 - DNA, 23 bp, Artificial Sequence
  Synthetic Construct
ggcaccagctcttccatctgtag

SEQ ID NO: 38423 - DNA, 19 bp, Artificial Sequence
  Synthetic Construct
gctgggcatggtggtgtgt

SEQ ID NO: 38424 - DNA, 19 bp, Artificial Sequence
  Synthetic Construct
gctgatggccccacacaca

SEQ ID NO: 38425 - DNA, 20 bp, Artificial Sequence
  Synthetic Construct
ggtgcccacacagaggaaga

SEQ ID NO: 38426 - DNA, 20 bp, Artificial Sequence
  Synthetic Construct
gcctgtcctcaggagccaaa

SEQ ID NO: 38427 - DNA, 24 bp, Artificial Sequence
  Synthetic Construct
caaacaggagtcagtgggtaatga

SEQ ID NO: 38428 - DNA, 23 bp, Artificial Sequence
  Synthetic Construct
ggtgagcagtttccagtgcaagt

SEQ ID NO: 38429 - DNA, 26 bp, Artificial Sequence
  Synthetic Construct
ccttgtcctcctaatgagctgactgt

SEQ ID NO: 38430 - DNA, 24 bp, Artificial Sequence
  Synthetic Construct
gcctgaggtctaagggagatgaac

SEQ ID NO: 38431 - DNA, 21 bp, Artificial Sequence
  Synthetic Construct
ttcactctgcggttgtgagaa

SEQ ID NO: 38432 - DNA, 28 bp, Artificial Sequence
  Synthetic Construct
ccccactacctagttccagaatactatc

SEQ ID NO: 38433 - DNA, 23 bp, Artificial Sequence
  Synthetic Construct
tctggagaggtgggagaggtttg

SEQ ID NO: 38434 - DNA, 20 bp, Artificial Sequence
  Synthetic Construct
agcagaaggctaccgtccaa

SEQ ID NO: 38435 - DNA, 22 bp, Artificial Sequence
  Synthetic Construct
ggaagtagtggtgccagcattg

SEQ ID NO: 38436 - DNA, 21 bp, Artificial Sequence
  Synthetic Construct
cacaccagcatctctccacat

SEQ ID NO: 38437 - DNA, 22 bp, Artificial Sequence
  Synthetic Construct
cgaacaggagcctcttctcaca

SEQ ID NO: 38438 - DNA, 24 bp, Artificial Sequence
  Synthetic Construct
gtccttttcaatggcgttgctaga

SEQ ID NO: 38439 - DNA, 23 bp, Artificial Sequence
  Synthetic Construct
cgacaacagacccctctccttct

SEQ ID NO: 38440 - DNA, 23 bp, Artificial Sequence
  Synthetic Construct
cagaggcctgaaatcgaggatga

SEQ ID NO: 38441 - DNA, 18 bp, Artificial Sequence
  Synthetic Construct
aggcaagccggtgccatt

SEQ ID NO: 38442 - DNA, 19 bp, Artificial Sequence
  Synthetic Construct
aggcaccgaagtcccaatg

SEQ ID NO: 38443 - DNA, 19 bp, Artificial Sequence
  Synthetic Construct
aggaggcaggtcgcggatt

SEQ ID NO: 38444 - DNA, 22 bp, Artificial Sequence
  Synthetic Construct
gtggagatcgaggcttgcttct

SEQ ID NO: 38445 - DNA, 22 bp, Artificial Sequence
  Synthetic Construct
cactgtgtttccaggcccaaac

SEQ ID NO: 38446 - DNA, 23 bp, Artificial Sequence
  Synthetic Construct
ggggaaagcagcgaaatggagtt

SEQ ID NO: 38447 - DNA, 24 bp, Artificial Sequence
  Synthetic Construct
gcatggagacgagtcagtgggaaa

SEQ ID NO: 38448 - DNA, 19 bp, Artificial Sequence
  Synthetic Construct
tctggtgcgagctttgctt

SEQ ID NO: 38449 - DNA, 22 bp, Artificial Sequence
  Synthetic Construct
gcactgagcgtgtagggtttga

SEQ ID NO: 38450 - DNA, 23 bp, Artificial Sequence
  Synthetic Construct
ccaaaatactcccctcccacgtt

SEQ ID NO: 38451 - DNA, 26 bp, Artificial Sequence
  Synthetic Construct
gcaaacctcagtagagagaactgtag

SEQ ID NO: 38452 - DNA, 24 bp, Artificial Sequence
  Synthetic Construct
gccaagaaaagacattggtcactt

SEQ ID NO: 38453 - DNA, 23 bp, Artificial Sequence
  Synthetic Construct
ggcctcttcagcgttgaaactgt

SEQ ID NO: 38454 - DNA, 23 bp, Artificial Sequence
  Synthetic Construct
ctgatcatggcccacatgtgtta

SEQ ID NO: 38455 - DNA, 20 bp, Artificial Sequence
  Synthetic Construct
atagcagcaccaggccacat

SEQ ID NO: 38456 - DNA, 21 bp, Artificial Sequence
  Synthetic Construct
gtgcgcagtttgtgattctga

SEQ ID NO: 38457 - DNA, 24 bp, Artificial Sequence
  Synthetic Construct
cgtgttgggctcaaaatgctgttc

SEQ ID NO: 38458 - DNA, 19 bp, Artificial Sequence
  Synthetic Construct
acacctgcccacgcacaca

SEQ ID NO: 38459 - DNA, 24 bp, Artificial Sequence
  Synthetic Construct
caccatcacagccaactccaaatg

SEQ ID NO: 38460 - DNA, 27 bp, Artificial Sequence
  Synthetic Construct
gctgctgaaaatattggctgtccagaa

SEQ ID NO: 38461 - DNA, 25 bp, Artificial Sequence
  Synthetic Construct
ggtacagccaaccaaattagacaag

SEQ ID NO: 38462 - DNA, 24 bp, Artificial Sequence
  Synthetic Construct
tgtggttccaagtcaatcacatct

SEQ ID NO: 38463 - DNA, 24 bp, Artificial Sequence
  Synthetic Construct
ccggagtggaatcatccctagttc

SEQ ID NO: 38464 - DNA, 20 bp, Artificial Sequence
  Synthetic Construct
atggtgggctctgcatcagt

SEQ ID NO: 38465 - DNA, 22 bp, Artificial Sequence
  Synthetic Construct
ctcttaccgagttccagccatt

SEQ ID NO: 38466 - DNA, 22 bp, Artificial Sequence
  Synthetic Construct
ggctgtagggaatgaaggaaca

SEQ ID NO: 38467 - DNA, 22 bp, Artificial Sequence
  Synthetic Construct
actgtgatgcaggctacacttc

SEQ ID NO: 38468 - DNA, 22 bp, Artificial Sequence
  Synthetic Construct
ggccagtagcattggctcacat

SEQ ID NO: 38469 - DNA, 24 bp, Artificial Sequence
  Synthetic Construct
cccagaagcctgctacttccattc

SEQ ID NO: 38470 - DNA, 24 bp, Artificial Sequence
  Synthetic Construct
actcaagactggactcaagcaatc

SEQ ID NO: 38471 - DNA, 20 bp, Artificial Sequence
  Synthetic Construct
gctcagacttgggcagaaca

SEQ ID NO: 38472 - DNA, 26 bp, Artificial Sequence
  Synthetic Construct
cagctcaacaaaattgaccccacaat

SEQ ID NO: 38473 - DNA, 22 bp, Artificial Sequence
  Synthetic Construct
cacactcatcggcccttgttac

SEQ ID NO: 38474 - DNA, 19 bp, Artificial Sequence
  Synthetic Construct
gcagagaggaggcgagtga

SEQ ID NO: 38475 - DNA, 23 bp, Artificial Sequence
  Synthetic Construct
cggcaaatgtaaacccagagcat

SEQ ID NO: 38476 - DNA, 23 bp, Artificial Sequence
  Synthetic Construct
tcctctcactgttcttccacctt

SEQ ID NO: 38477 - DNA, 30 bp, Artificial Sequence
  Synthetic Construct
ccctggaaggtaatttacatgctctgatac

SEQ ID NO: 38478 - DNA, 27 bp, Artificial Sequence
  Synthetic Construct
ccatgaggcatagcatttaccagaaac

SEQ ID NO: 38479 - DNA, 22 bp, Artificial Sequence
  Synthetic Construct
gcgactttgagcccatccttct

SEQ ID NO: 38480 - DNA, 20 bp, Artificial Sequence
  Synthetic Construct
agcactggcgaagcaccaaa

SEQ ID NO: 38481 - DNA, 23 bp, Artificial Sequence
  Synthetic Construct
gtgtgcttcagcatgccagttag

SEQ ID NO: 38482 - DNA, 20 bp, Artificial Sequence
  Synthetic Construct
atgccttttccgggcgtgtt

SEQ ID NO: 38483 - DNA, 25 bp, Artificial Sequence
  Synthetic Construct
tgaaactggagaaccaaaggtgtaa

SEQ ID NO: 38484 - DNA, 22 bp, Artificial Sequence
  Synthetic Construct
ctgagtcacctggaaggtctgt

SEQ ID NO: 38485 - DNA, 20 bp, Artificial Sequence
  Synthetic Construct
gtaagtggggctctgtgctt

SEQ ID NO: 38486 - DNA, 23 bp, Artificial Sequence
  Synthetic Construct
gcaggttcagtgactcttcatca

SEQ ID NO: 38487 - DNA, 24 bp, Artificial Sequence
  Synthetic Construct
tgagtcctaatctcagctccatct

SEQ ID NO: 38488 - DNA, 22 bp, Artificial Sequence
  Synthetic Construct
cttatctcaccacgcggtaact

SEQ ID NO: 38489 - DNA, 23 bp, Artificial Sequence
  Synthetic Construct
ggcagcaattggtgagagacaag

SEQ ID NO: 38490 - DNA, 23 bp, Artificial Sequence
  Synthetic Construct
cctgttgacactggcttggaaca

SEQ ID NO: 38491 - DNA, 19 bp, Artificial Sequence
  Synthetic Construct
gggcagcacagtcctcact

SEQ ID NO: 38492 - DNA, 23 bp, Artificial Sequence
  Synthetic Construct
ggtttgtaggccatgggatctct

SEQ ID NO: 38493 - DNA, 20 bp, Artificial Sequence
  Synthetic Construct
ccgtgcctgtgtgcatgtta

SEQ ID NO: 38494 - DNA, 22 bp, Artificial Sequence
  Synthetic Construct
gctcactcccagttggtgcaat

SEQ ID NO: 38495 - DNA, 23 bp, Artificial Sequence
  Synthetic Construct
gacccaaagaagccaaggtcaga

SEQ ID NO: 38496 - DNA, 26 bp, Artificial Sequence
  Synthetic Construct
ctcacctactctcaaggtaactgttc

SEQ ID NO: 38497 - DNA, 22 bp, Artificial Sequence
  Synthetic Construct
ccacctgtatggagcggcaata

SEQ ID NO: 38498 - DNA, 24 bp, Artificial Sequence
  Synthetic Construct
gtctcccaagtaacggagactaca

SEQ ID NO: 38499 - DNA, 19 bp, Artificial Sequence
  Synthetic Construct
tcggtgccccttggcttgt

SEQ ID NO: 38500 - DNA, 24 bp, Artificial Sequence
  Synthetic Construct
gaggtaaagccaggagctcaaatc

SEQ ID NO: 38501 - DNA, 25 bp, Artificial Sequence
  Synthetic Construct
gtgaagtaaaggggcaaggagaaga

SEQ ID NO: 38502 - DNA, 20 bp, Artificial Sequence
  Synthetic Construct
ccgtccaacgtgcactgaat

SEQ ID NO: 38503 - DNA, 21 bp, Artificial Sequence
  Synthetic Construct
agctccgtcctaacccacgaa

SEQ ID NO: 38504 - DNA, 25 bp, Artificial Sequence
  Synthetic Construct
ctgcggtgtagataactgagtgaag

SEQ ID NO: 38505 - DNA, 21 bp, Artificial Sequence
  Synthetic Construct
gtgcagaagcaccttggttgt

SEQ ID NO: 38506 - DNA, 21 bp, Artificial Sequence
  Synthetic Construct
gtgttgtgtgcacgtgtgttc

SEQ ID NO: 38507 - DNA, 22 bp, Artificial Sequence
  Synthetic Construct
ttgcgttcagggagaggagaga

SEQ ID NO: 38508 - DNA, 22 bp, Artificial Sequence
  Synthetic Construct
ccgccttcacctctctttgagt

SEQ ID NO: 38509 - DNA, 26 bp, Artificial Sequence
  Synthetic Construct
ggagctttgaaaacttccgacactct

SEQ ID NO: 38510 - DNA, 21 bp, Artificial Sequence
  Synthetic Construct
ccacttgctggagttccttga

SEQ ID NO: 38511 - DNA, 26 bp, Artificial Sequence
  Synthetic Construct
gggtggcatgaactttacacccaatg

SEQ ID NO: 38512 - DNA, 23 bp, Artificial Sequence
  Synthetic Construct
cctgtttgcagatccagccttct

SEQ ID NO: 38513 - DNA, 26 bp, Artificial Sequence
  Synthetic Construct
cccttggattctgatgccatctcgtt

SEQ ID NO: 38514 - DNA, 30 bp, Artificial Sequence
  Synthetic Construct
ctgggatgttaattccctctctagttcaag

SEQ ID NO: 38515 - DNA, 21 bp, Artificial Sequence
  Synthetic Construct
acagcgccctctgctatccat

SEQ ID NO: 38516 - DNA, 23 bp, Artificial Sequence
  Synthetic Construct
ggcgcaaccagaaatgtggctta

SEQ ID NO: 38517 - DNA, 22 bp, Artificial Sequence
  Synthetic Construct
acatggtggtcccagctactca

SEQ ID NO: 38518 - DNA, 24 bp, Artificial Sequence
  Synthetic Construct
gggagacagccagagcaactcatt

SEQ ID NO: 38519 - DNA, 20 bp, Artificial Sequence
  Synthetic Construct
tccctggagaccggtgtttt

SEQ ID NO: 38520 - DNA, 21 bp, Artificial Sequence
  Synthetic Construct
gatcacacccaaaggcactga

SEQ ID NO: 38521 - DNA, 22 bp, Artificial Sequence
  Synthetic Construct
cgtgcccatttgcaatccattc

SEQ ID NO: 38522 - DNA, 23 bp, Artificial Sequence
  Synthetic Construct
gaagaagagattctggggagcaa

SEQ ID NO: 38523 - DNA, 22 bp, Artificial Sequence
  Synthetic Construct
tgggttggatttgggtgagtct

SEQ ID NO: 38524 - DNA, 19 bp, Artificial Sequence
  Synthetic Construct
gctgcttcgcgttcacaaa

SEQ ID NO: 38525 - DNA, 26 bp, Artificial Sequence
  Synthetic Construct
cctccctcgttaacttcccttgtttc

SEQ ID NO: 38526 - DNA, 20 bp, Artificial Sequence
  Synthetic Construct
gctgcaagggcttcctgaaa

SEQ ID NO: 38527 - DNA, 21 bp, Artificial Sequence
  Synthetic Construct
tgagggaggccctgtcctttt

SEQ ID NO: 38528 - DNA, 26 bp, Artificial Sequence
  Synthetic Construct
ccctgattctcaagacctctttgttg

SEQ ID NO: 38529 - DNA, 20 bp, Artificial Sequence
  Synthetic Construct
ccaggggcctgggaaacttg

SEQ ID NO: 38530 - DNA, 22 bp, Artificial Sequence
  Synthetic Construct
cagcgatggagctagtctgtga

SEQ ID NO: 38531 - DNA, 26 bp, Artificial Sequence
  Synthetic Construct
ggaggtgtaaccaacttcacctggaa

SEQ ID NO: 38532 - DNA, 23 bp, Artificial Sequence
  Synthetic Construct
cgcatataacaggcacccagcaa

SEQ ID NO: 38533 - DNA, 20 bp, Artificial Sequence
  Synthetic Construct
tgggccgtctttccctgaga

SEQ ID NO: 38534 - DNA, 22 bp, Artificial Sequence
  Synthetic Construct
ccacgtgtcttcgtccatcttc

SEQ ID NO: 38535 - DNA, 20 bp, Artificial Sequence
  Synthetic Construct
ggggacctttgctccgtttg

SEQ ID NO: 38536 - DNA, 22 bp, Artificial Sequence
  Synthetic Construct
cccagaaggaagttggggaaac

SEQ ID NO: 38537 - DNA, 21 bp, Artificial Sequence
  Synthetic Construct
aggctgtagacggcgaggtta

SEQ ID NO: 38538 - DNA, 20 bp, Artificial Sequence
  Synthetic Construct
acacgccccagtctccactt

SEQ ID NO: 38539 - DNA, 20 bp, Artificial Sequence
  Synthetic Construct
gccctgcagaactcccaact

SEQ ID NO: 38540 - DNA, 21 bp, Artificial Sequence
  Synthetic Construct
accaccctctcactgcagctt

SEQ ID NO: 38541 - DNA, 20 bp, Artificial Sequence
  Synthetic Construct
aagatgagggcgctgtgact

SEQ ID NO: 38542 - DNA, 23 bp, Artificial Sequence
  Synthetic Construct
ggggaagacgatgaagacagcaa

SEQ ID NO: 38543 - DNA, 20 bp, Artificial Sequence
  Synthetic Construct
gggaggcaagggagtcatct

SEQ ID NO: 38544 - DNA, 20 bp, Artificial Sequence
  Synthetic Construct
aagtggcagcgccagtggaa

SEQ ID NO: 38545 - DNA, 21 bp, Artificial Sequence
  Synthetic Construct
agccacacaggacaggacttg

SEQ ID NO: 38546 - DNA, 23 bp, Artificial Sequence
  Synthetic Construct
ctcagtgcccaggtagtgatttc

SEQ ID NO: 38547 - DNA, 20 bp, Artificial Sequence
  Synthetic Construct
gcgagtcgctgaacctctct

SEQ ID NO: 38548 - DNA, 20 bp, Artificial Sequence
  Synthetic Construct
aggtcttgctgtgggtcttg

SEQ ID NO: 38549 - DNA, 19 bp, Artificial Sequence
  Synthetic Construct
agtgcctggcatcctgcta

SEQ ID NO: 38550 - DNA, 22 bp, Artificial Sequence
  Synthetic Construct
tgaggcctggggtatttgaaga

SEQ ID NO: 38551 - DNA, 23 bp, Artificial Sequence
  Synthetic Construct
gcccacagaaggttgttttcgtt

SEQ ID NO: 38552 - DNA, 23 bp, Artificial Sequence
  Synthetic Construct
gcttggccaatgacagcctttct

SEQ ID NO: 38553 - DNA, 21 bp, Artificial Sequence
  Synthetic Construct
accagcctcaatgtggagttg

SEQ ID NO: 38554 - DNA, 25 bp, Artificial Sequence
  Synthetic Construct
gcagaagtctccacactgtcctaga

SEQ ID NO: 38555 - DNA, 21 bp, Artificial Sequence
  Synthetic Construct
gcctacatcccgggctcattt

SEQ ID NO: 38556 - DNA, 21 bp, Artificial Sequence
  Synthetic Construct
gaaaacaaccccaggcgtttc

SEQ ID NO: 38557 - DNA, 25 bp, Artificial Sequence
  Synthetic Construct
gcttctctgggtctcaagacataat

SEQ ID NO: 38558 - DNA, 22 bp, Artificial Sequence
  Synthetic Construct
cacccacgtttgctggacttac

SEQ ID NO: 38559 - DNA, 23 bp, Artificial Sequence
  Synthetic Construct
gctcttcgttggttccagccttt

SEQ ID NO: 38560 - DNA, 24 bp, Artificial Sequence
  Synthetic Construct
actctttgtgaaaccagctcctta

SEQ ID NO: 38561 - DNA, 20 bp, Artificial Sequence
  Synthetic Construct
aacccagggcgtggcattct

SEQ ID NO: 38562 - DNA, 21 bp, Artificial Sequence
  Synthetic Construct
gtgcgcttattgcaccacttg

SEQ ID NO: 38563 - DNA, 28 bp, Artificial Sequence
  Synthetic Construct
gcctaggagaatctatactcaaccaaag

SEQ ID NO: 38564 - DNA, 22 bp, Artificial Sequence
  Synthetic Construct
cccagtgaatatgggcctgatg

SEQ ID NO: 38565 - DNA, 22 bp, Artificial Sequence
  Synthetic Construct
gcagacaggaggctctttccat

SEQ ID NO: 38566 - DNA, 23 bp, Artificial Sequence
  Synthetic Construct
cagtctcactttccctgcacctt

SEQ ID NO: 38567 - DNA, 25 bp, Artificial Sequence
  Synthetic Construct
ccagcagattcacactgtagacaca

SEQ ID NO: 38568 - DNA, 21 bp, Artificial Sequence
  Synthetic Construct
gagaatggccaaggtgtggaa

SEQ ID NO: 38569 - DNA, 20 bp, Artificial Sequence
  Synthetic Construct
agcaaggttgagcagccaat

SEQ ID NO: 38570 - DNA, 30 bp, Artificial Sequence
  Synthetic Construct
ggagagatgttcttattgttcagacctctt

SEQ ID NO: 38571 - DNA, 21 bp, Artificial Sequence
  Synthetic Construct
atccctcatcccctggctttg

SEQ ID NO: 38572 - DNA, 19 bp, Artificial Sequence
  Synthetic Construct
aagggaacgcggtggttag

SEQ ID NO: 38573 - DNA, 25 bp, Artificial Sequence
  Synthetic Construct
agagaattagggtgaggaaccttga

SEQ ID NO: 38574 - DNA, 20 bp, Artificial Sequence
  Synthetic Construct
ttgcccctctgttggtctga

SEQ ID NO: 38575 - DNA, 23 bp, Artificial Sequence
  Synthetic Construct
ccatacagtgagctgtggagcta

SEQ ID NO: 38576 - DNA, 27 bp, Artificial Sequence
  Synthetic Construct
gggaataagagtgtagctccaaagtga

SEQ ID NO: 38577 - DNA, 22 bp, Artificial Sequence
  Synthetic Construct
ccaaaacgttgggatgcagcaa

SEQ ID NO: 38578 - DNA, 23 bp, Artificial Sequence
  Synthetic Construct
cacccaaatgtcacttgctggat

SEQ ID NO: 38579 - DNA, 22 bp, Artificial Sequence
  Synthetic Construct
caggaggttctcagctctgttg

SEQ ID NO: 38580 - DNA, 23 bp, Artificial Sequence
  Synthetic Construct
ctgtggagagggaaggctgataa

SEQ ID NO: 38581 - DNA, 23 bp, Artificial Sequence
  Synthetic Construct
aacctttctttcaagggctgtct

SEQ ID NO: 38582 - DNA, 20 bp, Artificial Sequence
  Synthetic Construct
gactgcaaggatggcaccaa

SEQ ID NO: 38583 - DNA, 20 bp, Artificial Sequence
  Synthetic Construct
cagccacctggaagctttgt

SEQ ID NO: 38584 - DNA, 22 bp, Artificial Sequence
  Synthetic Construct
tgacctcccaggttgagggaat

SEQ ID NO: 38585 - DNA, 22 bp, Artificial Sequence
  Synthetic Construct
gcagcagatgagatgggagcta

SEQ ID NO: 38586 - DNA, 22 bp, Artificial Sequence
  Synthetic Construct
ggctcaccacataccagtcctt

SEQ ID NO: 38587 - DNA, 22 bp, Artificial Sequence
  Synthetic Construct
cagccagctctgggagaaaaga

SEQ ID NO: 38588 - DNA, 22 bp, Artificial Sequence
  Synthetic Construct
gtgtgacatgccatgactgaga

SEQ ID NO: 38589 - DNA, 22 bp, Artificial Sequence
  Synthetic Construct
ccatggttcctcctctgccatt

SEQ ID NO: 38590 - DNA, 25 bp, Artificial Sequence
  Synthetic Construct
cctgagagcactgaaacctctcctt

SEQ ID NO: 38591 - DNA, 26 bp, Artificial Sequence
  Synthetic Construct
ccagtaatgatgaggcagatgtcttg

SEQ ID NO: 38592 - DNA, 20 bp, Artificial Sequence
  Synthetic Construct
tgttagcggctggaggatga

SEQ ID NO: 38593 - DNA, 22 bp, Artificial Sequence
  Synthetic Construct
ggaaccatgcttaaccccatct

SEQ ID NO: 38594 - DNA, 22 bp, Artificial Sequence
  Synthetic Construct
ccagatggctagcattgacctt

SEQ ID NO: 38595 - DNA, 24 bp, Artificial Sequence
  Synthetic Construct
ggcactgtatgcctagtgcctttg

SEQ ID NO: 38596 - DNA, 24 bp, Artificial Sequence
  Synthetic Construct
gcttgccaaagtcagagagagtca

SEQ ID NO: 38597 - DNA, 24 bp, Artificial Sequence
  Synthetic Construct
ggggaagtgcatgatcctgagtga

SEQ ID NO: 38598 - DNA, 25 bp, Artificial Sequence
  Synthetic Construct
tgactctcggttaatgtctttgctt

SEQ ID NO: 38599 - DNA, 21 bp, Artificial Sequence
  Synthetic Construct
cacatgaccactgctgctgtt

SEQ ID NO: 38600 - DNA, 20 bp, Artificial Sequence
  Synthetic Construct
gtggcgcacatgtggcattt

SEQ ID NO: 38601 - DNA, 20 bp, Artificial Sequence
  Synthetic Construct
ggcatggggcagtgagtatt

SEQ ID NO: 38602 - DNA, 25 bp, Artificial Sequence
  Synthetic Construct
gggttgcattgctcccttattcagt

SEQ ID NO: 38603 - DNA, 22 bp, Artificial Sequence
  Synthetic Construct
gagctggcttcctcatcatctt

SEQ ID NO: 38604 - DNA, 25 bp, Artificial Sequence
  Synthetic Construct
gcattcctaggaggtcaattcttct

SEQ ID NO: 38605 - DNA, 22 bp, Artificial Sequence
  Synthetic Construct
cttggtgtagacgaggttgtga

SEQ ID NO: 38606 - DNA, 24 bp, Artificial Sequence
  Synthetic Construct
ggctgaatgtacccagccaagtca

SEQ ID NO: 38607 - DNA, 23 bp, Artificial Sequence
  Synthetic Construct
ccactccatccgtaaaccatttg

SEQ ID NO: 38608 - DNA, 20 bp, Artificial Sequence
  Synthetic Construct
ggttgcacaggcctcagttg

SEQ ID NO: 38609 - DNA, 20 bp, Artificial Sequence
  Synthetic Construct
gctatttccgaggccacagt

SEQ ID NO: 38610 - DNA, 24 bp, Artificial Sequence
  Synthetic Construct
ggaggtctcaaaaccggtcagatg

SEQ ID NO: 38611 - DNA, 23 bp, Artificial Sequence
  Synthetic Construct
acacagaggactttttgggcatt

SEQ ID NO: 38612 - DNA, 22 bp, Artificial Sequence
  Synthetic Construct
tgatggaaggtcctgggctttg

SEQ ID NO: 38613 - DNA, 21 bp, Artificial Sequence
  Synthetic Construct
tgcttccacccctgctctatg

SEQ ID NO: 38614 - DNA, 18 bp, Artificial Sequence
  Synthetic Construct
tgctgctggccccttctt

SEQ ID NO: 38615 - DNA, 27 bp, Artificial Sequence
  Synthetic Construct
gcaaaataggcattacctccattcaac

SEQ ID NO: 38616 - DNA, 19 bp, Artificial Sequence
  Synthetic Construct
gcgtgggaggcctgaagat

SEQ ID NO: 38617 - DNA, 22 bp, Artificial Sequence
  Synthetic Construct
acaccgaaaagggcaagaaagt

SEQ ID NO: 38618 - DNA, 25 bp, Artificial Sequence
  Synthetic Construct
ggtggagacagtaggacctcagaag

SEQ ID NO: 38619 - DNA, 21 bp, Artificial Sequence
  Synthetic Construct
gggtaggggagggttgcaaat

SEQ ID NO: 38620 - DNA, 22 bp, Artificial Sequence
  Synthetic Construct
gagatctggcagggtaggatga

SEQ ID NO: 38621 - DNA, 19 bp, Artificial Sequence
  Synthetic Construct
agtcccaggctggctggat

SEQ ID NO: 38622 - DNA, 21 bp, Artificial Sequence
  Synthetic Construct
gcgtttgcagttcccatttca

SEQ ID NO: 38623 - DNA, 24 bp, Artificial Sequence
  Synthetic Construct
acagaaaaccaacatagccccaaa

SEQ ID NO: 38624 - DNA, 24 bp, Artificial Sequence
  Synthetic Construct
ttggccaataaaaggacagtgaac

SEQ ID NO: 38625 - DNA, 20 bp, Artificial Sequence
  Synthetic Construct
ccagaagccggaagttgtgt

SEQ ID NO: 38626 - DNA, 22 bp, Artificial Sequence
  Synthetic Construct
gtgaatgaccagctggctgtag

SEQ ID NO: 38627 - DNA, 25 bp, Artificial Sequence
  Synthetic Construct
caggactcaccttagtcccatacaa

SEQ ID NO: 38628 - DNA, 23 bp, Artificial Sequence
  Synthetic Construct
gagaagggaccaagccaatttca

SEQ ID NO: 38629 - DNA, 23 bp, Artificial Sequence
  Synthetic Construct
tggccttacattacagccattct

SEQ ID NO: 38630 - DNA, 21 bp, Artificial Sequence
  Synthetic Construct
ttccaccaccactcccagtga

SEQ ID NO: 38631 - DNA, 22 bp, Artificial Sequence
  Synthetic Construct
aggtagggccctgaaagctatg

SEQ ID NO: 38632 - DNA, 29 bp, Artificial Sequence
  Synthetic Construct
cccagatcatattttgggaaagaggttca

SEQ ID NO: 38633 - DNA, 23 bp, Artificial Sequence
  Synthetic Construct
ctgaaggcactagggaaggatgt

SEQ ID NO: 38634 - DNA, 22 bp, Artificial Sequence
  Synthetic Construct
gggattctcccacctcaacctt

SEQ ID NO: 38635 - DNA, 23 bp, Artificial Sequence
  Synthetic Construct
ccctttggtgattcagcatggta

SEQ ID NO: 38636 - DNA, 22 bp, Artificial Sequence
  Synthetic Construct
caggagttggtgttcagtcaga

SEQ ID NO: 38637 - DNA, 24 bp, Artificial Sequence
  Synthetic Construct
ccccagagtctttgaaaagtgcat

SEQ ID NO: 38638 - DNA, 23 bp, Artificial Sequence
  Synthetic Construct
gtgaagcgatttgctggaactca

SEQ ID NO: 38639 - DNA, 25 bp, Artificial Sequence
  Synthetic Construct
ctctctttctctctggcctcaattc

SEQ ID NO: 38640 - DNA, 23 bp, Artificial Sequence
  Synthetic Construct
cccttgtgttggactgtggttgt

SEQ ID NO: 38641 - DNA, 23 bp, Artificial Sequence
  Synthetic Construct
gaccatacaagacagcacaggta

SEQ ID NO: 38642 - DNA, 28 bp, Artificial Sequence
  Synthetic Construct
gtggtagattctagctacttccacaatg

SEQ ID NO: 38643 - DNA, 20 bp, Artificial Sequence
  Synthetic Construct
tgtcagaaggcgaccaggat

SEQ ID NO: 38644 - DNA, 24 bp, Artificial Sequence
  Synthetic Construct
gagaatcaaccactttgcctgcat

SEQ ID NO: 38645 - DNA, 22 bp, Artificial Sequence
  Synthetic Construct
gggctttcagctcccagttaca

SEQ ID NO: 38646 - DNA, 20 bp, Artificial Sequence
  Synthetic Construct
accccaaagcggcaagaagt

SEQ ID NO: 38647 - DNA, 20 bp, Artificial Sequence
  Synthetic Construct
acctgggcctttgtggtgat

SEQ ID NO: 38648 - DNA, 27 bp, Artificial Sequence
  Synthetic Construct
agggacagtctcctagatctaactatc

SEQ ID NO: 38649 - DNA, 21 bp, Artificial Sequence
  Synthetic Construct
acaaacaaacccaggcagtgt

SEQ ID NO: 38650 - DNA, 21 bp, Artificial Sequence
  Synthetic Construct
agctggagctaggctgctgaa

SEQ ID NO: 38651 - DNA, 22 bp, Artificial Sequence
  Synthetic Construct
ccagaaccactctctccactga

SEQ ID NO: 38652 - DNA, 22 bp, Artificial Sequence
  Synthetic Construct
tgactggatcccagtgctgttg

SEQ ID NO: 38653 - DNA, 27 bp, Artificial Sequence
  Synthetic Construct
cgtttggcaaaaccttaatccacatag

SEQ ID NO: 38654 - DNA, 21 bp, Artificial Sequence
  Synthetic Construct
tcctggtcagatgcccacaag

SEQ ID NO: 38655 - DNA, 27 bp, Artificial Sequence
  Synthetic Construct
ggggacattccatagtccatacctttg

SEQ ID NO: 38656 - DNA, 22 bp, Artificial Sequence
  Synthetic Construct
gaatgggtgaggggagacaatc

SEQ ID NO: 38657 - DNA, 19 bp, Artificial Sequence
  Synthetic Construct
tgaaggggctgaggacaca

SEQ ID NO: 38658 - DNA, 19 bp, Artificial Sequence
  Synthetic Construct
tggcccatgcctgctccat

SEQ ID NO: 38659 - DNA, 19 bp, Artificial Sequence
  Synthetic Construct
agggatgcaacccgactgt

SEQ ID NO: 38660 - DNA, 25 bp, Artificial Sequence
  Synthetic Construct
gctaatacaacctctgagcctgact

SEQ ID NO: 38661 - DNA, 25 bp, Artificial Sequence
  Synthetic Construct
ggacagccaatccagatcaccttct

SEQ ID NO: 38662 - DNA, 19 bp, Artificial Sequence
  Synthetic Construct
ccaggagcctggtcacctt

SEQ ID NO: 38663 - DNA, 22 bp, Artificial Sequence
  Synthetic Construct
ggtgaggtccaagaagctggaa

SEQ ID NO: 38664 - DNA, 21 bp, Artificial Sequence
  Synthetic Construct
tctccagaggcctgaggttag

SEQ ID NO: 38665 - DNA, 24 bp, Artificial Sequence
  Synthetic Construct
gctttccacatcctccataaccat

SEQ ID NO: 38666 - DNA, 22 bp, Artificial Sequence
  Synthetic Construct
cccacagttctccagtgtcaga

SEQ ID NO: 38667 - DNA, 19 bp, Artificial Sequence
  Synthetic Construct
aggtgtccctgccttgcat

SEQ ID NO: 38668 - DNA, 25 bp, Artificial Sequence
  Synthetic Construct
tccgaattcttgacaccagtcttag

SEQ ID NO: 38669 - DNA, 23 bp, Artificial Sequence
  Synthetic Construct
gtgcagcctactactgtttcctt

SEQ ID NO: 38670 - DNA, 23 bp, Artificial Sequence
  Synthetic Construct
gacggaaccaagatgttctccat

SEQ ID NO: 38671 - DNA, 20 bp, Artificial Sequence
  Synthetic Construct
tatttgccccggggtctttg

SEQ ID NO: 38672 - DNA, 23 bp, Artificial Sequence
  Synthetic Construct
ggctgccctgcaattattgaact

SEQ ID NO: 38673 - DNA, 24 bp, Artificial Sequence
  Synthetic Construct
ggagaccaacttttggggaagaag

SEQ ID NO: 38674 - DNA, 21 bp, Artificial Sequence
  Synthetic Construct
gattcagcaccaagggtccat

SEQ ID NO: 38675 - DNA, 22 bp, Artificial Sequence
  Synthetic Construct
ccagaggaagtttgtgccatga

SEQ ID NO: 38676 - DNA, 22 bp, Artificial Sequence
  Synthetic Construct
cagacgttagcacccacacttg

SEQ ID NO: 38677 - DNA, 24 bp, Artificial Sequence
  Synthetic Construct
gggcttcaggcatagtttgaattg

SEQ ID NO: 38678 - DNA, 20 bp, Artificial Sequence
  Synthetic Construct
cctccgcacaagttgcaatg

SEQ ID NO: 38679 - DNA, 29 bp, Artificial Sequence
  Synthetic Construct
cagctagctctaaatgagttttggagaca

SEQ ID NO: 38680 - DNA, 21 bp, Artificial Sequence
  Synthetic Construct
tactgagcagccgtggactga

SEQ ID NO: 38681 - DNA, 26 bp, Artificial Sequence
  Synthetic Construct
cctgttatacagggccagatgtcttc

SEQ ID NO: 38682 - DNA, 21 bp, Artificial Sequence
  Synthetic Construct
tgcagaccctgtctccatctt

SEQ ID NO: 38683 - DNA, 22 bp, Artificial Sequence
  Synthetic Construct
cctgtgatggttccccgttctt

SEQ ID NO: 38684 - DNA, 20 bp, Artificial Sequence
  Synthetic Construct
gtggctcatggtggcagtaa

SEQ ID NO: 38685 - DNA, 22 bp, Artificial Sequence
  Synthetic Construct
agggatgggtcagaggttgttc

SEQ ID NO: 38686 - DNA, 27 bp, Artificial Sequence
  Synthetic Construct
agacaatccagtaataaccacctgaag

SEQ ID NO: 38687 - DNA, 22 bp, Artificial Sequence
  Synthetic Construct
gacagggcttagcttccacatc

SEQ ID NO: 38688 - DNA, 24 bp, Artificial Sequence
  Synthetic Construct
caccggggactggtctcttatttg

SEQ ID NO: 38689 - DNA, 20 bp, Artificial Sequence
  Synthetic Construct
tgctgcaggggagttcttca

SEQ ID NO: 38690 - DNA, 23 bp, Artificial Sequence
  Synthetic Construct
ttcaagacctgaacacgaagtga

SEQ ID NO: 38691 - DNA, 28 bp, Artificial Sequence
  Synthetic Construct
gacttagaacaactgcctcctacttttg

SEQ ID NO: 38692 - DNA, 21 bp, Artificial Sequence
  Synthetic Construct
gctgggtccctcacacttctt

SEQ ID NO: 38693 - DNA, 22 bp, Artificial Sequence
  Synthetic Construct
gccctctgaaacctcctacttc

SEQ ID NO: 38694 - DNA, 20 bp, Artificial Sequence
  Synthetic Construct
gcccggtgtcttttcccttt

SEQ ID NO: 38695 - DNA, 23 bp, Artificial Sequence
  Synthetic Construct
cccagcaagctggagataaaact

SEQ ID NO: 38696 - DNA, 24 bp, Artificial Sequence
  Synthetic Construct
gctctaaaatgcccattcccatgt

SEQ ID NO: 38697 - DNA, 20 bp, Artificial Sequence
  Synthetic Construct
gggcagtccagagagacaca

SEQ ID NO: 38698 - DNA, 25 bp, Artificial Sequence
  Synthetic Construct
aataccagaaaacacccctcttcaa

SEQ ID NO: 38699 - DNA, 19 bp, Artificial Sequence
  Synthetic Construct
ccactgcgctgcaggaaac

SEQ ID NO: 38700 - DNA, 23 bp, Artificial Sequence
  Synthetic Construct
tctgctcagcaaaagatcactct

SEQ ID NO: 38701 - DNA, 25 bp, Artificial Sequence
  Synthetic Construct
ggctgatattgacagccagggtttg

SEQ ID NO: 38702 - DNA, 23 bp, Artificial Sequence
  Synthetic Construct
cccaggcaaagtatgtgggtact

SEQ ID NO: 38703 - DNA, 28 bp, Artificial Sequence
  Synthetic Construct
ctcttctgttaaccaatgaaccccattc

SEQ ID NO: 38704 - DNA, 18 bp, Artificial Sequence
  Synthetic Construct
cgcagccagttgctgtca

SEQ ID NO: 38705 - DNA, 24 bp, Artificial Sequence
  Synthetic Construct
tcaggacagtcatttctgctctac

SEQ ID NO: 38706 - DNA, 22 bp, Artificial Sequence
  Synthetic Construct
tgagggatgggcttatcacaga

SEQ ID NO: 38707 - DNA, 24 bp, Artificial Sequence
  Synthetic Construct
gttgtttctcccacctcttcacaa

SEQ ID NO: 38708 - DNA, 26 bp, Artificial Sequence
  Synthetic Construct
gtgtcctggagactaaattggctaga

SEQ ID NO: 38709 - DNA, 24 bp, Artificial Sequence
  Synthetic Construct
gcaagtagggtccatctactcaca

SEQ ID NO: 38710 - DNA, 26 bp, Artificial Sequence
  Synthetic Construct
cgggaggtttagtaacaggagacaag

SEQ ID NO: 38711 - DNA, 23 bp, Artificial Sequence
  Synthetic Construct
ggtgtatgcctccatgaccttga

SEQ ID NO: 38712 - DNA, 22 bp, Artificial Sequence
  Synthetic Construct
gcatatgctccagcctcaggta

SEQ ID NO: 38713 - DNA, 21 bp, Artificial Sequence
  Synthetic Construct
ggcccctctgtttctgtcctt

SEQ ID NO: 38714 - DNA, 25 bp, Artificial Sequence
  Synthetic Construct
cgcatggcttatataggcggtctgt

SEQ ID NO: 38715 - DNA, 19 bp, Artificial Sequence
  Synthetic Construct
atccccagcacggctgact

SEQ ID NO: 38716 - DNA, 24 bp, Artificial Sequence
  Synthetic Construct
cagcaactttgctttagtctgcat

SEQ ID NO: 38717 - DNA, 22 bp, Artificial Sequence
  Synthetic Construct
agccaggccaatcaggatcaag

SEQ ID NO: 38718 - DNA, 20 bp, Artificial Sequence
  Synthetic Construct
gcaaggtgggtggagcaaca

SEQ ID NO: 38719 - DNA, 20 bp, Artificial Sequence
  Synthetic Construct
gccaggtcttgccatccaaa

SEQ ID NO: 38720 - DNA, 20 bp, Artificial Sequence
  Synthetic Construct
tacctcacaggtcggtgcaa

SEQ ID NO: 38721 - DNA, 24 bp, Artificial Sequence
  Synthetic Construct
gcatttctggttttcaacgtgtct

SEQ ID NO: 38722 - DNA, 19 bp, Artificial Sequence
  Synthetic Construct
ccccatgctccatgtgcaa

SEQ ID NO: 38723 - DNA, 25 bp, Artificial Sequence
  Synthetic Construct
tgaccacttgttaccactgaaacat

SEQ ID NO: 38724 - DNA, 22 bp, Artificial Sequence
  Synthetic Construct
gtcgtgaccaaaggcagacatc

SEQ ID NO: 38725 - DNA, 22 bp, Artificial Sequence
  Synthetic Construct
agagatacacctcccagcatga

SEQ ID NO: 38726 - DNA, 22 bp, Artificial Sequence
  Synthetic Construct
ggttagcctcacccacctgttc

SEQ ID NO: 38727 - DNA, 24 bp, Artificial Sequence
  Synthetic Construct
gcaatgagctcttgatccatctga

SEQ ID NO: 38728 - DNA, 24 bp, Artificial Sequence
  Synthetic Construct
gagggtggatagaacggttacact

SEQ ID NO: 38729 - DNA, 25 bp, Artificial Sequence
  Synthetic Construct
cccagaaggttaagaggcttaggaa

SEQ ID NO: 38730 - DNA, 20 bp, Artificial Sequence
  Synthetic Construct
ggaaaggcgaccccgaactt

SEQ ID NO: 38731 - DNA, 25 bp, Artificial Sequence
  Synthetic Construct
gcagaagcattagcagtcagctcta

SEQ ID NO: 38732 - DNA, 20 bp, Artificial Sequence
  Synthetic Construct
agggcaggtgggtacagtga

SEQ ID NO: 38733 - DNA, 22 bp, Artificial Sequence
  Synthetic Construct
gcagagggcagatgaaggaaag

SEQ ID NO: 38734 - DNA, 21 bp, Artificial Sequence
  Synthetic Construct
gaagcagagccaccatagctt

SEQ ID NO: 38735 - DNA, 26 bp, Artificial Sequence
  Synthetic Construct
gggccaacttctgattctaggtcaag

SEQ ID NO: 38736 - DNA, 24 bp, Artificial Sequence
  Synthetic Construct
cccaggtagagtcactgcttctgt

SEQ ID NO: 38737 - DNA, 22 bp, Artificial Sequence
  Synthetic Construct
agacttccagaggaccccattg

SEQ ID NO: 38738 - DNA, 19 bp, Artificial Sequence
  Synthetic Construct
accctccccaccaccttct

SEQ ID NO: 38739 - DNA, 21 bp, Artificial Sequence
  Synthetic Construct
gcagttgacaggaagcagaga

SEQ ID NO: 38740 - DNA, 22 bp, Artificial Sequence
  Synthetic Construct
tccaaacagaccttccctcaga

SEQ ID NO: 38741 - DNA, 19 bp, Artificial Sequence
  Synthetic Construct
atccagttggcgcccttgt

SEQ ID NO: 38742 - DNA, 19 bp, Artificial Sequence
  Synthetic Construct
cccaagaggggctgctatg

SEQ ID NO: 38743 - DNA, 28 bp, Artificial Sequence
  Synthetic Construct
gccctaattaatggtctggtaacctttc

SEQ ID NO: 38744 - DNA, 22 bp, Artificial Sequence
  Synthetic Construct
ggagtcaggttgttagcactgt

SEQ ID NO: 38745 - DNA, 20 bp, Artificial Sequence
  Synthetic Construct
aggctgcaggtcctttctga

SEQ ID NO: 38746 - DNA, 20 bp, Artificial Sequence
  Synthetic Construct
cccagcatccccacttggaa

SEQ ID NO: 38747 - DNA, 21 bp, Artificial Sequence
  Synthetic Construct
cgagctcacctcactctgtca

SEQ ID NO: 38748 - DNA, 22 bp, Artificial Sequence
  Synthetic Construct
tgcctcccacctctaccctatt

SEQ ID NO: 38749 - DNA, 26 bp, Artificial Sequence
  Synthetic Construct
tcatgataggtagatacgcaggtgat

SEQ ID NO: 38750 - DNA, 19 bp, Artificial Sequence
  Synthetic Construct
ggaccgcttcggtgtggaa

SEQ ID NO: 38751 - DNA, 19 bp, Artificial Sequence
  Synthetic Construct
tgggcagcaggaccccaaa

SEQ ID NO: 38752 - DNA, 21 bp, Artificial Sequence
  Synthetic Construct
agtgaagcccgggtacctgat

SEQ ID NO: 38753 - DNA, 20 bp, Artificial Sequence
  Synthetic Construct
aacagcctgtgcgtgggata

SEQ ID NO: 38754 - DNA, 20 bp, Artificial Sequence
  Synthetic Construct
tctgcctcttcctgctggtt

SEQ ID NO: 38755 - DNA, 25 bp, Artificial Sequence
  Synthetic Construct
gtcacagttaaagagcaggaacact

SEQ ID NO: 38756 - DNA, 20 bp, Artificial Sequence
  Synthetic Construct
agaggcagtggcagtcaaac

SEQ ID NO: 38757 - DNA, 19 bp, Artificial Sequence
  Synthetic Construct
gcacacccaaggtcagcaa

SEQ ID NO: 38758 - DNA, 25 bp, Artificial Sequence
  Synthetic Construct
gagtaggattaggcagagggagaaa

SEQ ID NO: 38759 - DNA, 25 bp, Artificial Sequence
  Synthetic Construct
ggaagggtttggctctgaatcattg

SEQ ID NO: 38760 - DNA, 22 bp, Artificial Sequence
  Synthetic Construct
gcatatgaggggccagggtttc

SEQ ID NO: 38761 - DNA, 22 bp, Artificial Sequence
  Synthetic Construct
ccctgtatggcagggagaaaga

SEQ ID NO: 38762 - DNA, 22 bp, Artificial Sequence
  Synthetic Construct
gagcctcccctaccatagcatt

SEQ ID NO: 38763 - DNA, 24 bp, Artificial Sequence
  Synthetic Construct
catgtgaattgtggtcagtgcaaa

SEQ ID NO: 38764 - DNA, 20 bp, Artificial Sequence
  Synthetic Construct
ggggaaggatttcccgttgt

SEQ ID NO: 38765 - DNA, 23 bp, Artificial Sequence
  Synthetic Construct
accctcacagggtgtttgttatc

SEQ ID NO: 38766 - DNA, 22 bp, Artificial Sequence
  Synthetic Construct
gccttttaacacccacctgtct

SEQ ID NO: 38767 - DNA, 22 bp, Artificial Sequence
  Synthetic Construct
gcatggggcaggagtgtaaaga

SEQ ID NO: 38768 - DNA, 24 bp, Artificial Sequence
  Synthetic Construct
gagacctgagctggactagaactt

SEQ ID NO: 38769 - DNA, 23 bp, Artificial Sequence
  Synthetic Construct
gcctccagcaacaatgagcactt

SEQ ID NO: 38770 - DNA, 18 bp, Artificial Sequence
  Synthetic Construct
acgtgggccaccagaaag

SEQ ID NO: 38771 - DNA, 22 bp, Artificial Sequence
  Synthetic Construct
cctcgggcacatgcctttagaa

SEQ ID NO: 38772 - DNA, 23 bp, Artificial Sequence
  Synthetic Construct
gaaataagtaccggggccctttc

SEQ ID NO: 38773 - DNA, 25 bp, Artificial Sequence
  Synthetic Construct
acaagtgcgtatcattcaaggaaca

SEQ ID NO: 38774 - DNA, 22 bp, Artificial Sequence
  Synthetic Construct
gcaggtggtgggcattcttgtt

SEQ ID NO: 38775 - DNA, 20 bp, Artificial Sequence
  Synthetic Construct
tgccgggccacagttcatac

SEQ ID NO: 38776 - DNA, 24 bp, Artificial Sequence
  Synthetic Construct
ccacctggtagcaaggatggagat

SEQ ID NO: 38777 - DNA, 20 bp, Artificial Sequence
  Synthetic Construct
ccagttggcttggggaagtt

SEQ ID NO: 38778 - DNA, 20 bp, Artificial Sequence
  Synthetic Construct
tggcaaacaccccagctgta

SEQ ID NO: 38779 - DNA, 25 bp, Artificial Sequence
  Synthetic Construct
cccaagtgatcatccctatcccata

SEQ ID NO: 38780 - DNA, 22 bp, Artificial Sequence
  Synthetic Construct
gggcggggatgtgaatcctaaa

SEQ ID NO: 38781 - DNA, 25 bp, Artificial Sequence
  Synthetic Construct
gtcctcacttacatgactccaggaa

SEQ ID NO: 38782 - DNA, 21 bp, Artificial Sequence
  Synthetic Construct
ggagcctggcatatgcagaaa

SEQ ID NO: 38783 - DNA, 25 bp, Artificial Sequence
  Synthetic Construct
gtggtcctgaatctaaagcgagact

SEQ ID NO: 38784 - DNA, 19 bp, Artificial Sequence
  Synthetic Construct
ggccctagccttggcttca

SEQ ID NO: 38785 - DNA, 22 bp, Artificial Sequence
  Synthetic Construct
cttctctgcacgttgtgcattc

SEQ ID NO: 38786 - DNA, 24 bp, Artificial Sequence
  Synthetic Construct
tctggcctgcactactgaaataag

SEQ ID NO: 38787 - DNA, 22 bp, Artificial Sequence
  Synthetic Construct
tgtatacagggaggcacagcta

SEQ ID NO: 38788 - DNA, 22 bp, Artificial Sequence
  Synthetic Construct
gcccagccacactaaattgcat

SEQ ID NO: 38789 - DNA, 22 bp, Artificial Sequence
  Synthetic Construct
cactgaccattccccttccttt

SEQ ID NO: 38790 - DNA, 22 bp, Artificial Sequence
  Synthetic Construct
actctaggtggtcggtggtgtt

SEQ ID NO: 38791 - DNA, 21 bp, Artificial Sequence
  Synthetic Construct
cggaaaaggaggcctcagtca

SEQ ID NO: 38792 - DNA, 21 bp, Artificial Sequence
  Synthetic Construct
ggtggctacaggtgcaaggat

SEQ ID NO: 38793 - DNA, 19 bp, Artificial Sequence
  Synthetic Construct
tggcagcagccaaacttct

SEQ ID NO: 38794 - DNA, 21 bp, Artificial Sequence
  Synthetic Construct
gccagagctgagcagtcatca

SEQ ID NO: 38795 - DNA, 21 bp, Artificial Sequence
  Synthetic Construct
ccacagtatcgccgctgacat

SEQ ID NO: 38796 - DNA, 20 bp, Artificial Sequence
  Synthetic Construct
aaagcctccgcctcttgttg

SEQ ID NO: 38797 - DNA, 20 bp, Artificial Sequence
  Synthetic Construct
tgctctccctgacaccatgt

SEQ ID NO: 38798 - DNA, 20 bp, Artificial Sequence
  Synthetic Construct
aggggagccaattggtgcaa

SEQ ID NO: 38799 - DNA, 22 bp, Artificial Sequence
  Synthetic Construct
gcagaggtcaggtgtgaagtga

SEQ ID NO: 38800 - DNA, 29 bp, Artificial Sequence
  Synthetic Construct
cagggaaatcctataactacccctcattc

SEQ ID NO: 38801 - DNA, 20 bp, Artificial Sequence
  Synthetic Construct
cctcctggctactcctctgt

SEQ ID NO: 38802 - DNA, 23 bp, Artificial Sequence
  Synthetic Construct
ggtctcaaactcctgggtacaag

SEQ ID NO: 38803 - DNA, 23 bp, Artificial Sequence
  Synthetic Construct
gcatgcccattgagtctgctact

SEQ ID NO: 38804 - DNA, 24 bp, Artificial Sequence
  Synthetic Construct
agtcccttgtggtttttactccat

SEQ ID NO: 38805 - DNA, 24 bp, Artificial Sequence
  Synthetic Construct
gcaggaggaggaagaggctaaatg

SEQ ID NO: 38806 - DNA, 20 bp, Artificial Sequence
  Synthetic Construct
gggtcgtgggcttcatcagt

SEQ ID NO: 38807 - DNA, 20 bp, Artificial Sequence
  Synthetic Construct
aagcctggccacacacatag

SEQ ID NO: 38808 - DNA, 24 bp, Artificial Sequence
  Synthetic Construct
ctgttgtggcacatgaacttttct

SEQ ID NO: 38809 - DNA, 24 bp, Artificial Sequence
  Synthetic Construct
gtcgtcctctcagtattccctttg

SEQ ID NO: 38810 - DNA, 24 bp, Artificial Sequence
  Synthetic Construct
gccaaaggtagcaacattgacact

SEQ ID NO: 38811 - DNA, 22 bp, Artificial Sequence
  Synthetic Construct
ccaaattcaggccccaggaaga

SEQ ID NO: 38812 - DNA, 22 bp, Artificial Sequence
  Synthetic Construct
cacttagcagccacctctcact

SEQ ID NO: 38813 - DNA, 21 bp, Artificial Sequence
  Synthetic Construct
aaatgccaggggaacaacctt

SEQ ID NO: 38814 - DNA, 24 bp, Artificial Sequence
  Synthetic Construct
ggtcgccgtacatgtaattagtga

SEQ ID NO: 38815 - DNA, 22 bp, Artificial Sequence
  Synthetic Construct
gcaaccataacaggggcctaga

SEQ ID NO: 38816 - DNA, 19 bp, Artificial Sequence
  Synthetic Construct
tccccgtgggcagagatga

SEQ ID NO: 38817 - DNA, 25 bp, Artificial Sequence
  Synthetic Construct
ggggaaaatcctctgcttgtggaaa

SEQ ID NO: 38818 - DNA, 20 bp, Artificial Sequence
  Synthetic Construct
tcccttgcccttctgctctt

SEQ ID NO: 38819 - DNA, 19 bp, Artificial Sequence
  Synthetic Construct
tccacccaacccactgcaa

SEQ ID NO: 38820 - DNA, 25 bp, Artificial Sequence
  Synthetic Construct
tggtggctgcttttacaatcttttg

SEQ ID NO: 38821 - DNA, 22 bp, Artificial Sequence
  Synthetic Construct
ggaccacagaatccagctcagt

SEQ ID NO: 38822 - DNA, 24 bp, Artificial Sequence
  Synthetic Construct
cccactggtgaaacctggttaatg

SEQ ID NO: 38823 - DNA, 21 bp, Artificial Sequence
  Synthetic Construct
ggtgaggccagtttcacttca

SEQ ID NO: 38824 - DNA, 19 bp, Artificial Sequence
  Synthetic Construct
tgccccacaggtgtgtcat

SEQ ID NO: 38825 - DNA, 23 bp, Artificial Sequence
  Synthetic Construct
tggaggatcttctcgaaggctat

SEQ ID NO: 38826 - DNA, 21 bp, Artificial Sequence
  Synthetic Construct
agctcagaccattgcctcttg

SEQ ID NO: 38827 - DNA, 22 bp, Artificial Sequence
  Synthetic Construct
ccagcttcaaaggggtgtttct

SEQ ID NO: 38828 - DNA, 20 bp, Artificial Sequence
  Synthetic Construct
acacaggtgcaagcccatag

SEQ ID NO: 38829 - DNA, 19 bp, Artificial Sequence
  Synthetic Construct
accaaggctgtgcctgttg

SEQ ID NO: 38830 - DNA, 20 bp, Artificial Sequence
  Synthetic Construct
caccggctctgccaaaacat

SEQ ID NO: 38831 - DNA, 18 bp, Artificial Sequence
  Synthetic Construct
tgtctcggccctcagctt

SEQ ID NO: 38832 - DNA, 24 bp, Artificial Sequence
  Synthetic Construct
ccaacctcatagcctgacactttc

SEQ ID NO: 38833 - DNA, 24 bp, Artificial Sequence
  Synthetic Construct
cctgcttctttgcccagatttttg

SEQ ID NO: 38834 - DNA, 22 bp, Artificial Sequence
  Synthetic Construct
ccaatgaatggctgtcctccaa

SEQ ID NO: 38835 - DNA, 22 bp, Artificial Sequence
  Synthetic Construct
ggttgggtgactttcccagact

SEQ ID NO: 38836 - DNA, 23 bp, Artificial Sequence
  Synthetic Construct
cagcttctggagagcttttctct

SEQ ID NO: 38837 - DNA, 21 bp, Artificial Sequence
  Synthetic Construct
agtgacagccttggcctctta

SEQ ID NO: 38838 - DNA, 18 bp, Artificial Sequence
  Synthetic Construct
tgccgggatcccttctca

SEQ ID NO: 38839 - DNA, 20 bp, Artificial Sequence
  Synthetic Construct
tgatgcctgcacagctcctt

SEQ ID NO: 38840 - DNA, 20 bp, Artificial Sequence
  Synthetic Construct
tgagcaccaaggagcccaaa

SEQ ID NO: 38841 - DNA, 19 bp, Artificial Sequence
  Synthetic Construct
ccagtgacccagggaccaa

SEQ ID NO: 38842 - DNA, 20 bp, Artificial Sequence
  Synthetic Construct
gggcagcacttcatcgttct

SEQ ID NO: 38843 - DNA, 20 bp, Artificial Sequence
  Synthetic Construct
tgggcaagggcatgtggtaa

SEQ ID NO: 38844 - DNA, 22 bp, Artificial Sequence
  Synthetic Construct
ggccaggaagcttgaggaagat

SEQ ID NO: 38845 - DNA, 23 bp, Artificial Sequence
  Synthetic Construct
ctgcaaagcacttttgggaacat

SEQ ID NO: 38846 - DNA, 21 bp, Artificial Sequence
  Synthetic Construct
aaccctgccctctgagagttg

SEQ ID NO: 38847 - DNA, 21 bp, Artificial Sequence
  Synthetic Construct
cacttcaaagccctcgtccat

SEQ ID NO: 38848 - DNA, 19 bp, Artificial Sequence
  Synthetic Construct
agcccaagccagagggaat

SEQ ID NO: 38849 - DNA, 25 bp, Artificial Sequence
  Synthetic Construct
cctcttgatcctttggactcgttga

SEQ ID NO: 38850 - DNA, 22 bp, Artificial Sequence
  Synthetic Construct
agagtctgtaggggaggacaca

SEQ ID NO: 38851 - DNA, 22 bp, Artificial Sequence
  Synthetic Construct
cggcctagggagacaccagtta

SEQ ID NO: 38852 - DNA, 22 bp, Artificial Sequence
  Synthetic Construct
cgtggtccaacagtgacaccta

SEQ ID NO: 38853 - DNA, 22 bp, Artificial Sequence
  Synthetic Construct
ccatgaaacccacagcctctaa

SEQ ID NO: 38854 - DNA, 22 bp, Artificial Sequence
  Synthetic Construct
tcccaaagcaggtggacagagt

SEQ ID NO: 38855 - DNA, 23 bp, Artificial Sequence
  Synthetic Construct
tttctgttgagctcccatgttct

SEQ ID NO: 38856 - DNA, 20 bp, Artificial Sequence
  Synthetic Construct
tccaagagtctgccctgtga

SEQ ID NO: 38857 - DNA, 23 bp, Artificial Sequence
  Synthetic Construct
gggtatcagcaccagctctaaca

SEQ ID NO: 38858 - DNA, 21 bp, Artificial Sequence
  Synthetic Construct
gacccagaagatgcacaggaa

SEQ ID NO: 38859 - DNA, 21 bp, Artificial Sequence
  Synthetic Construct
tcaaccccaggagcccaaatg

SEQ ID NO: 38860 - DNA, 22 bp, Artificial Sequence
  Synthetic Construct
tgccatgggtgattcttcatgt

SEQ ID NO: 38861 - DNA, 28 bp, Artificial Sequence
  Synthetic Construct
gggacccaccataaataacaaagacact

SEQ ID NO: 38862 - DNA, 23 bp, Artificial Sequence
  Synthetic Construct
gtctctggctttccttgcctaca

SEQ ID NO: 38863 - DNA, 23 bp, Artificial Sequence
  Synthetic Construct
tgggtctcagggtggatagaaac

SEQ ID NO: 38864 - DNA, 28 bp, Artificial Sequence
  Synthetic Construct
gctcctgatgtgtgtcataaacccttac

SEQ ID NO: 38865 - DNA, 21 bp, Artificial Sequence
  Synthetic Construct
ccagacagcctcatactgcaa

SEQ ID NO: 38866 - DNA, 22 bp, Artificial Sequence
  Synthetic Construct
agagagagctgaggggtacagt

SEQ ID NO: 38867 - DNA, 20 bp, Artificial Sequence
  Synthetic Construct
gcatgcctggagcctgagat

SEQ ID NO: 38868 - DNA, 22 bp, Artificial Sequence
  Synthetic Construct
ggaagagttgtgggaggcttac

SEQ ID NO: 38869 - DNA, 19 bp, Artificial Sequence
  Synthetic Construct
gcagctgtgagtgcagctt

SEQ ID NO: 38870 - DNA, 22 bp, Artificial Sequence
  Synthetic Construct
tccttcttgcctcccaccattg

SEQ ID NO: 38871 - DNA, 22 bp, Artificial Sequence
  Synthetic Construct
aacagaagcttccctccagttc

SEQ ID NO: 38872 - DNA, 22 bp, Artificial Sequence
  Synthetic Construct
tggtgaccagataaccctcaca

SEQ ID NO: 38873 - DNA, 22 bp, Artificial Sequence
  Synthetic Construct
tgcaggaacagggaagcctatc

SEQ ID NO: 38874 - DNA, 23 bp, Artificial Sequence
  Synthetic Construct
cccagtggatagcccctactcaa

SEQ ID NO: 38875 - DNA, 28 bp, Artificial Sequence
  Synthetic Construct
gggaataactaatgaaaggggcctgaga

SEQ ID NO: 38876 - DNA, 24 bp, Artificial Sequence
  Synthetic Construct
ggggtcagaatcaagttccaaagt

SEQ ID NO: 38877 - DNA, 22 bp, Artificial Sequence
  Synthetic Construct
cctagactcccaggaccccttt

SEQ ID NO: 38878 - DNA, 22 bp, Artificial Sequence
  Synthetic Construct
ggacaagcaggccctgtaaaag

SEQ ID NO: 38879 - DNA, 25 bp, Artificial Sequence
  Synthetic Construct
cactcaccatttagggacaccaaca

SEQ ID NO: 38880 - DNA, 20 bp, Artificial Sequence
  Synthetic Construct
tcctggttgctctggctcta

SEQ ID NO: 38881 - DNA, 25 bp, Artificial Sequence
  Synthetic Construct
tcccatgaacacagtatggtagaag

SEQ ID NO: 38882 - DNA, 20 bp, Artificial Sequence
  Synthetic Construct
ccttgggtctcgcagacttc

SEQ ID NO: 38883 - DNA, 29 bp, Artificial Sequence
  Synthetic Construct
gcttgtctacattgcaggtagcaatacaa

SEQ ID NO: 38884 - DNA, 20 bp, Artificial Sequence
  Synthetic Construct
tggcctgccacacaatgact

SEQ ID NO: 38885 - DNA, 21 bp, Artificial Sequence
  Synthetic Construct
tgtgcagaaaggagacgcaaa

SEQ ID NO: 38886 - DNA, 19 bp, Artificial Sequence
  Synthetic Construct
agcaccctgctgccaagaa

SEQ ID NO: 38887 - DNA, 24 bp, Artificial Sequence
  Synthetic Construct
ccggggtgcataagtgaggctaat

SEQ ID NO: 38888 - DNA, 23 bp, Artificial Sequence
  Synthetic Construct
gcggtaaagaagctggccaaatc

SEQ ID NO: 38889 - DNA, 30 bp, Artificial Sequence
  Synthetic Construct
ggtgggattgtcattagttcttacaggttt

SEQ ID NO: 38890 - DNA, 20 bp, Artificial Sequence
  Synthetic Construct
aaggagagcgaaggcaccat

SEQ ID NO: 38891 - DNA, 21 bp, Artificial Sequence
  Synthetic Construct
ctcaaaccagcctgggaaaga

SEQ ID NO: 38892 - DNA, 21 bp, Artificial Sequence
  Synthetic Construct
tcagggaagggatgggcttgt

SEQ ID NO: 38893 - DNA, 19 bp, Artificial Sequence
  Synthetic Construct
ggcacaggctgaccgactt

SEQ ID NO: 38894 - DNA, 20 bp, Artificial Sequence
  Synthetic Construct
tagctcagtggcccctcaaa

SEQ ID NO: 38895 - DNA, 18 bp, Artificial Sequence
  Synthetic Construct
ggccattggctggcaaga

SEQ ID NO: 38896 - DNA, 22 bp, Artificial Sequence
  Synthetic Construct
ggcagcctccttttgcagtaga

SEQ ID NO: 38897 - DNA, 22 bp, Artificial Sequence
  Synthetic Construct
gcccaggaatttgaggccatag

SEQ ID NO: 38898 - DNA, 22 bp, Artificial Sequence
  Synthetic Construct
tccctcctaccagagtgagtgt

SEQ ID NO: 38899 - DNA, 24 bp, Artificial Sequence
  Synthetic Construct
cctgagaacatggctccaggaaag

SEQ ID NO: 38900 - DNA, 23 bp, Artificial Sequence
  Synthetic Construct
gctcactgcagtctcaacttttg

SEQ ID NO: 38901 - DNA, 22 bp, Artificial Sequence
  Synthetic Construct
ccagctctcagtgttcccatag

SEQ ID NO: 38902 - DNA, 27 bp, Artificial Sequence
  Synthetic Construct
cctgtgaaataacagctgacaatcctt

SEQ ID NO: 38903 - DNA, 24 bp, Artificial Sequence
  Synthetic Construct
gcctgatggaactgtgtgccttac

SEQ ID NO: 38904 - DNA, 26 bp, Artificial Sequence
  Synthetic Construct
tgtgtctcctggagtttatctagttg

SEQ ID NO: 38905 - DNA, 21 bp, Artificial Sequence
  Synthetic Construct
gggatcggcctactgaaggaa

SEQ ID NO: 38906 - DNA, 20 bp, Artificial Sequence
  Synthetic Construct
gggcaccaggagtaatgctt

SEQ ID NO: 38907 - DNA, 26 bp, Artificial Sequence
  Synthetic Construct
ccctgttaccattttccaaagcaaag

SEQ ID NO: 38908 - DNA, 21 bp, Artificial Sequence
  Synthetic Construct
ggcaaggggctctgtcaagta

SEQ ID NO: 38909 - DNA, 22 bp, Artificial Sequence
  Synthetic Construct
tcagggctacctgaccatcaca

SEQ ID NO: 38910 - DNA, 23 bp, Artificial Sequence
  Synthetic Construct
cctctctcctaacagcccagaga

SEQ ID NO: 38911 - DNA, 20 bp, Artificial Sequence
  Synthetic Construct
tgacaggtaggccagctttg

SEQ ID NO: 38912 - DNA, 20 bp, Artificial Sequence
  Synthetic Construct
tcccacttctggcaggatga

SEQ ID NO: 38913 - DNA, 27 bp, Artificial Sequence
  Synthetic Construct
ccaacccacctattgagaaaggaattg

SEQ ID NO: 38914 - DNA, 21 bp, Artificial Sequence
  Synthetic Construct
actggaaggagggaacagctt

SEQ ID NO: 38915 - DNA, 20 bp, Artificial Sequence
  Synthetic Construct
agccctgctgtaaggactgt

SEQ ID NO: 38916 - DNA, 24 bp, Artificial Sequence
  Synthetic Construct
aatgcagaaagtcatggtgtgaag

SEQ ID NO: 38917 - DNA, 24 bp, Artificial Sequence
  Synthetic Construct
caccaattgccactactgctcttc

SEQ ID NO: 38918 - DNA, 22 bp, Artificial Sequence
  Synthetic Construct
gcttgggttatgcctgctgcaa

SEQ ID NO: 38919 - DNA, 24 bp, Artificial Sequence
  Synthetic Construct
ctgcactcaggacttggagttttg

SEQ ID NO: 38920 - DNA, 22 bp, Artificial Sequence
  Synthetic Construct
ggctctaaaacgcagggctgtt

SEQ ID NO: 38921 - DNA, 22 bp, Artificial Sequence
  Synthetic Construct
gactaacaacagggagccagaa

SEQ ID NO: 38922 - DNA, 20 bp, Artificial Sequence
  Synthetic Construct
acaaggcccctcctgctgaa

SEQ ID NO: 38923 - DNA, 21 bp, Artificial Sequence
  Synthetic Construct
caggggctccaggttaggaat

SEQ ID NO: 38924 - DNA, 21 bp, Artificial Sequence
  Synthetic Construct
tgcaccccatgaaggttttgt

SEQ ID NO: 38925 - DNA, 24 bp, Artificial Sequence
  Synthetic Construct
ggtgagtggtgccactttcacttc

SEQ ID NO: 38926 - DNA, 19 bp, Artificial Sequence
  Synthetic Construct
gggagtggcaccccagaaa

SEQ ID NO: 38927 - DNA, 20 bp, Artificial Sequence
  Synthetic Construct
gcctgcttcaccgccttttt

SEQ ID NO: 38928 - DNA, 22 bp, Artificial Sequence
  Synthetic Construct
tgcctcgaagaggtttggtatc

SEQ ID NO: 38929 - DNA, 20 bp, Artificial Sequence
  Synthetic Construct
aggccgtggagggacgtgat

SEQ ID NO: 38930 - DNA, 22 bp, Artificial Sequence
  Synthetic Construct
gccaaaggcaattcatgtgcaa

SEQ ID NO: 38931 - DNA, 22 bp, Artificial Sequence
  Synthetic Construct
gtgctcccctcagagtgagatt

SEQ ID NO: 38932 - DNA, 24 bp, Artificial Sequence
  Synthetic Construct
cctctccctctgaagcaagacagt

SEQ ID NO: 38933 - DNA, 20 bp, Artificial Sequence
  Synthetic Construct
atggcacaggggcccaaaat

SEQ ID NO: 38934 - DNA, 27 bp, Artificial Sequence
  Synthetic Construct
gggcttggagaatatacagtgatctga

SEQ ID NO: 38935 - DNA, 23 bp, Artificial Sequence
  Synthetic Construct
aggacatggatgtgatgctgatg

SEQ ID NO: 38936 - DNA, 22 bp, Artificial Sequence
  Synthetic Construct
ctgaaccagcccaggcaaaatc

SEQ ID NO: 38937 - DNA, 22 bp, Artificial Sequence
  Synthetic Construct
ggtggaggaatcctgcctaaca

SEQ ID NO: 38938 - DNA, 24 bp, Artificial Sequence
  Synthetic Construct
caagctgtagtagttcagccactt

SEQ ID NO: 38939 - DNA, 23 bp, Artificial Sequence
  Synthetic Construct
gagctgggttctgaaggatgaag

SEQ ID NO: 38940 - DNA, 24 bp, Artificial Sequence
  Synthetic Construct
ggagaagcagaagattcgacaaga

SEQ ID NO: 38941 - DNA, 20 bp, Artificial Sequence
  Synthetic Construct
gacgctggcaagtcagtcaa

SEQ ID NO: 38942 - DNA, 20 bp, Artificial Sequence
  Synthetic Construct
tgcccacttcccttcacaga

SEQ ID NO: 38943 - DNA, 26 bp, Artificial Sequence
  Synthetic Construct
ggtggaagaaagaaccacagaaatga

SEQ ID NO: 38944 - DNA, 21 bp, Artificial Sequence
  Synthetic Construct
tgcttagccatcatcgccatt

SEQ ID NO: 38945 - DNA, 25 bp, Artificial Sequence
  Synthetic Construct
tctttggttccctctgttttaggaa

SEQ ID NO: 38946 - DNA, 21 bp, Artificial Sequence
  Synthetic Construct
ggaagggtgttgccctgaaca

SEQ ID NO: 38947 - DNA, 22 bp, Artificial Sequence
  Synthetic Construct
gtcccattgtttctgcccaact

SEQ ID NO: 38948 - DNA, 22 bp, Artificial Sequence
  Synthetic Construct
ggaccaatgagcagaagaggaa

SEQ ID NO: 38949 - DNA, 29 bp, Artificial Sequence
  Synthetic Construct
cagtttcatgtactaggagaagtgtgaac

SEQ ID NO: 38950 - DNA, 24 bp, Artificial Sequence
  Synthetic Construct
gcaatgactggagtgtagggtatg

SEQ ID NO: 38951 - DNA, 26 bp, Artificial Sequence
  Synthetic Construct
gaggctatttagaccttccagccata

SEQ ID NO: 38952 - DNA, 20 bp, Artificial Sequence
  Synthetic Construct
cctggccatttgctccagaa

SEQ ID NO: 38953 - DNA, 21 bp, Artificial Sequence
  Synthetic Construct
catttgccagggccattcact

SEQ ID NO: 38954 - DNA, 25 bp, Artificial Sequence
  Synthetic Construct
cattaatgcctgagtagccctcttc

SEQ ID NO: 38955 - DNA, 20 bp, Artificial Sequence
  Synthetic Construct
tctccccactctggctgtga

SEQ ID NO: 38956 - DNA, 23 bp, Artificial Sequence
  Synthetic Construct
cacctggaagccagagaatgtca

SEQ ID NO: 38957 - DNA, 21 bp, Artificial Sequence
  Synthetic Construct
acaacccaagggatcggtgta

SEQ ID NO: 38958 - DNA, 21 bp, Artificial Sequence
  Synthetic Construct
gtgtcagtagggtccggttct

SEQ ID NO: 38959 - DNA, 20 bp, Artificial Sequence
  Synthetic Construct
acctgtgagtgcgagtccat

SEQ ID NO: 38960 - DNA, 22 bp, Artificial Sequence
  Synthetic Construct
tcccatccaaggcagaggtact

SEQ ID NO: 38961 - DNA, 19 bp, Artificial Sequence
  Synthetic Construct
cctgctgcccaagcaactt

SEQ ID NO: 38962 - DNA, 26 bp, Artificial Sequence
  Synthetic Construct
ccccttttatcctataaaccctcaca

SEQ ID NO: 38963 - DNA, 30 bp, Artificial Sequence
  Synthetic Construct
gctgtttacagagacctttgaagtcagaac

SEQ ID NO: 38964 - DNA, 18 bp, Artificial Sequence
  Synthetic Construct
agccagggctgtctgcat

SEQ ID NO: 38965 - DNA, 22 bp, Artificial Sequence
  Synthetic Construct
cagcgaaccatgagctcacatc

SEQ ID NO: 38966 - DNA, 22 bp, Artificial Sequence
  Synthetic Construct
cccatgagaagcctgggtcttg

SEQ ID NO: 38967 - DNA, 27 bp, Artificial Sequence
  Synthetic Construct
gagctttaaagaacaagggtacctgat

SEQ ID NO: 38968 - DNA, 21 bp, Artificial Sequence
  Synthetic Construct
agggacacagagccgacacat

SEQ ID NO: 38969 - DNA, 27 bp, Artificial Sequence
  Synthetic Construct
caccactgagagcaaagaagagtcatt

SEQ ID NO: 38970 - DNA, 20 bp, Artificial Sequence
  Synthetic Construct
gcgccactaaccatgtcaga

SEQ ID NO: 38971 - DNA, 22 bp, Artificial Sequence
  Synthetic Construct
ggcgtccaagcacatgaaggaa

SEQ ID NO: 38972 - DNA, 23 bp, Artificial Sequence
  Synthetic Construct
gcttactagtgaggcagggttca

SEQ ID NO: 38973 - DNA, 22 bp, Artificial Sequence
  Synthetic Construct
gctgccacagagaacagcaatg

SEQ ID NO: 38974 - DNA, 19 bp, Artificial Sequence
  Synthetic Construct
aacagcagcgcccctcaat

SEQ ID NO: 38975 - DNA, 21 bp, Artificial Sequence
  Synthetic Construct
taggtctgcccgccttacagt

SEQ ID NO: 38976 - DNA, 22 bp, Artificial Sequence
  Synthetic Construct
ggaaaccaggacaagcgtcact

SEQ ID NO: 38977 - DNA, 20 bp, Artificial Sequence
  Synthetic Construct
tgcaagcctcatggcctcaa

SEQ ID NO: 38978 - DNA, 25 bp, Artificial Sequence
  Synthetic Construct
acattgagaaggaagaaggagcatt

SEQ ID NO: 38979 - DNA, 25 bp, Artificial Sequence
  Synthetic Construct
gggagattttgggaggcgattaagt

SEQ ID NO: 38980 - DNA, 21 bp, Artificial Sequence
  Synthetic Construct
tgatctgaccccagcccttct

SEQ ID NO: 38981 - DNA, 20 bp, Artificial Sequence
  Synthetic Construct
agcagggtggggagtgtaga

SEQ ID NO: 38982 - DNA, 23 bp, Artificial Sequence
  Synthetic Construct
gcctcatctccatgacaaccaaa

SEQ ID NO: 38983 - DNA, 19 bp, Artificial Sequence
  Synthetic Construct
gggtcagcagccctggatt

SEQ ID NO: 38984 - DNA, 23 bp, Artificial Sequence
  Synthetic Construct
ggctttggccttttgctcataca

SEQ ID NO: 38985 - DNA, 26 bp, Artificial Sequence
  Synthetic Construct
gacagttaccctcataaatgggaaga

SEQ ID NO: 38986 - DNA, 20 bp, Artificial Sequence
  Synthetic Construct
aaggtcagggctgcctgttt

SEQ ID NO: 38987 - DNA, 24 bp, Artificial Sequence
  Synthetic Construct
tcaggagccaagtttatgcttgat

SEQ ID NO: 38988 - DNA, 20 bp, Artificial Sequence
  Synthetic Construct
gcccctcacaaagcctcatt

SEQ ID NO: 38989 - DNA, 19 bp, Artificial Sequence
  Synthetic Construct
tgatgcccggaggcagatt

SEQ ID NO: 38990 - DNA, 22 bp, Artificial Sequence
  Synthetic Construct
ttgggagtagaggccaggacaa

SEQ ID NO: 38991 - DNA, 24 bp, Artificial Sequence
  Synthetic Construct
gcccctgtttattcctcccctgat

SEQ ID NO: 38992 - DNA, 22 bp, Artificial Sequence
  Synthetic Construct
gaagggcctgtttttcccaaga

SEQ ID NO: 38993 - DNA, 21 bp, Artificial Sequence
  Synthetic Construct
catccagagaggccaccatct

SEQ ID NO: 38994 - DNA, 24 bp, Artificial Sequence
  Synthetic Construct
gccttcacttaaatgtcaggcaaa

SEQ ID NO: 38995 - DNA, 21 bp, Artificial Sequence
  Synthetic Construct
acctctggggagagggtcctt

SEQ ID NO: 38996 - DNA, 19 bp, Artificial Sequence
  Synthetic Construct
ggcctggcttcccatggtt

SEQ ID NO: 38997 - DNA, 21 bp, Artificial Sequence
  Synthetic Construct
ttgatctcaccgcccctgaac

SEQ ID NO: 38998 - DNA, 24 bp, Artificial Sequence
  Synthetic Construct
cactgggacacctacgttccttac

SEQ ID NO: 38999 - DNA, 22 bp, Artificial Sequence
  Synthetic Construct
acggtcaggcctttctcgtaca

SEQ ID NO: 39000 - DNA, 28 bp, Artificial Sequence
  Synthetic Construct
ccttcattccagtgtgatacagaacaac

SEQ ID NO: 39001 - DNA, 23 bp, Artificial Sequence
  Synthetic Construct
ggccagatgattgctccctctac

SEQ ID NO: 39002 - DNA, 22 bp, Artificial Sequence
  Synthetic Construct
cccgattcctgactctttgcat

SEQ ID NO: 39003 - DNA, 22 bp, Artificial Sequence
  Synthetic Construct
ccattcagcaggtcccaagttt

SEQ ID NO: 39004 - DNA, 24 bp, Artificial Sequence
  Synthetic Construct
cttcaggttgtccttaaccacgtt

SEQ ID NO: 39005 - DNA, 19 bp, Artificial Sequence
  Synthetic Construct
gcctgggtgcaaggctcaa

SEQ ID NO: 39006 - DNA, 19 bp, Artificial Sequence
  Synthetic Construct
gcgaaggccaccacctcat

SEQ ID NO: 39007 - DNA, 23 bp, Artificial Sequence
  Synthetic Construct
gagctccacgtgtacttactgaa

SEQ ID NO: 39008 - DNA, 25 bp, Artificial Sequence
  Synthetic Construct
tccttcatgtaggcaggtagaaatg

SEQ ID NO: 39009 - DNA, 24 bp, Artificial Sequence
  Synthetic Construct
ggggaggtttgaacttggctggaa

SEQ ID NO: 39010 - DNA, 30 bp, Artificial Sequence
  Synthetic Construct
gccaaatagggacttctaagtacaacacaa

SEQ ID NO: 39011 - DNA, 19 bp, Artificial Sequence
  Synthetic Construct
aatgctgctgtgggcagaa

SEQ ID NO: 39012 - DNA, 25 bp, Artificial Sequence
  Synthetic Construct
tcagagagtctgaaacgaatcacat

SEQ ID NO: 39013 - DNA, 21 bp, Artificial Sequence
  Synthetic Construct
tgcccaggtcattacccttct

SEQ ID NO: 39014 - DNA, 21 bp, Artificial Sequence
  Synthetic Construct
cctcctacccacaagcacaca

SEQ ID NO: 39015 - DNA, 21 bp, Artificial Sequence
  Synthetic Construct
ggaacgaggagggcaccattt

SEQ ID NO: 39016 - DNA, 22 bp, Artificial Sequence
  Synthetic Construct
tgggtgttctcacccagttaca

SEQ ID NO: 39017 - DNA, 23 bp, Artificial Sequence
  Synthetic Construct
ccatcctcagggtgttcttgcta

SEQ ID NO: 39018 - DNA, 22 bp, Artificial Sequence
  Synthetic Construct
gctggagcgatactcgcttttc

SEQ ID NO: 39019 - DNA, 22 bp, Artificial Sequence
  Synthetic Construct
tggggtggaagagtgaacaaac

SEQ ID NO: 39020 - DNA, 22 bp, Artificial Sequence
  Synthetic Construct
ggctgatgcgaggtgagtgaaa

SEQ ID NO: 39021 - DNA, 21 bp, Artificial Sequence
  Synthetic Construct
ggcagtttgtccagccttaca

SEQ ID NO: 39022 - DNA, 22 bp, Artificial Sequence
  Synthetic Construct
tgtccacacagaagctgctaat

SEQ ID NO: 39023 - DNA, 24 bp, Artificial Sequence
  Synthetic Construct
ttccaggtgtcaaatacacgagtt

SEQ ID NO: 39024 - DNA, 24 bp, Artificial Sequence
  Synthetic Construct
gtacagtgctcagtgactaggttt

SEQ ID NO: 39025 - DNA, 20 bp, Artificial Sequence
  Synthetic Construct
aaatggcgctgggagaggaa

SEQ ID NO: 39026 - DNA, 30 bp, Artificial Sequence
  Synthetic Construct
gggatgcttcctaatgcttctttaagacta

SEQ ID NO: 39027 - DNA, 22 bp, Artificial Sequence
  Synthetic Construct
tgtcctcaaggagccatgaaag

SEQ ID NO: 39028 - DNA, 27 bp, Artificial Sequence
  Synthetic Construct
gctctacgatacaccatagctccctta

SEQ ID NO: 39029 - DNA, 22 bp, Artificial Sequence
  Synthetic Construct
cctgaacagggtgagggaggta

SEQ ID NO: 39030 - DNA, 27 bp, Artificial Sequence
  Synthetic Construct
gctggacaattttctaggtgctgactt

SEQ ID NO: 39031 - DNA, 20 bp, Artificial Sequence
  Synthetic Construct
ggcctcagcctgctttcact

SEQ ID NO: 39032 - DNA, 23 bp, Artificial Sequence
  Synthetic Construct
gctgatggattgactggctgtga

SEQ ID NO: 39033 - DNA, 21 bp, Artificial Sequence
  Synthetic Construct
agaggccctcaccatgtaaga

SEQ ID NO: 39034 - DNA, 25 bp, Artificial Sequence
  Synthetic Construct
gctctcagtaaaggagggtgaggaa

SEQ ID NO: 39035 - DNA, 25 bp, Artificial Sequence
  Synthetic Construct
caggattctgaggtcatggaggaat

SEQ ID NO: 39036 - DNA, 22 bp, Artificial Sequence
  Synthetic Construct
ctcagctcttcaccaggaccat

SEQ ID NO: 39037 - DNA, 24 bp, Artificial Sequence
  Synthetic Construct
ggacatcgaccccagttagtgttc

SEQ ID NO: 39038 - DNA, 20 bp, Artificial Sequence
  Synthetic Construct
cccaaagtgcaaggctgtca

SEQ ID NO: 39039 - DNA, 22 bp, Artificial Sequence
  Synthetic Construct
gtcccatgtttggggatagcat

SEQ ID NO: 39040 - DNA, 22 bp, Artificial Sequence
  Synthetic Construct
tgggtgcctcattctgagtaca

SEQ ID NO: 39041 - DNA, 21 bp, Artificial Sequence
  Synthetic Construct
agaccttggacttggtgcaaa

SEQ ID NO: 39042 - DNA, 24 bp, Artificial Sequence
  Synthetic Construct
actctgcctagtgtccatctttct

SEQ ID NO: 39043 - DNA, 26 bp, Artificial Sequence
  Synthetic Construct
ggtaccaaccaccgatttctgagttc

SEQ ID NO: 39044 - DNA, 22 bp, Artificial Sequence
  Synthetic Construct
gtcagggtgcaaggtagctaag

SEQ ID NO: 39045 - DNA, 22 bp, Artificial Sequence
  Synthetic Construct
ggttaggcaggaagccaagtct

SEQ ID NO: 39046 - DNA, 22 bp, Artificial Sequence
  Synthetic Construct
gcagggagaagcattgtcaaga

SEQ ID NO: 39047 - DNA, 22 bp, Artificial Sequence
  Synthetic Construct
ggtttgaccccacagccttagt

SEQ ID NO: 39048 - DNA, 22 bp, Artificial Sequence
  Synthetic Construct
gccctggaatgtggagtctatc

SEQ ID NO: 39049 - DNA, 24 bp, Artificial Sequence
  Synthetic Construct
gaagtagccactctttgcttccaa

SEQ ID NO: 39050 - DNA, 26 bp, Artificial Sequence
  Synthetic Construct
ccaccttctcaggttgcatctctatc

SEQ ID NO: 39051 - DNA, 24 bp, Artificial Sequence
  Synthetic Construct
ccccacagagcagtgagaataaca

SEQ ID NO: 39052 - DNA, 22 bp, Artificial Sequence
  Synthetic Construct
gctgcacatttgtgctggattg

SEQ ID NO: 39053 - DNA, 21 bp, Artificial Sequence
  Synthetic Construct
ccatcttggcctccgcctatg

SEQ ID NO: 39054 - DNA, 24 bp, Artificial Sequence
  Synthetic Construct
gctggttctctgagctgacaccaa

SEQ ID NO: 39055 - DNA, 20 bp, Artificial Sequence
  Synthetic Construct
aggcctccacagtggtaaga

SEQ ID NO: 39056 - DNA, 19 bp, Artificial Sequence
  Synthetic Construct
cggcctggagatgccttgt

SEQ ID NO: 39057 - DNA, 19 bp, Artificial Sequence
  Synthetic Construct
cctttgggctgccccttgt

SEQ ID NO: 39058 - DNA, 26 bp, Artificial Sequence
  Synthetic Construct
gcatactagaaggctagggtgtgaga

SEQ ID NO: 39059 - DNA, 18 bp, Artificial Sequence
  Synthetic Construct
atggccaggaggcacctt

SEQ ID NO: 39060 - DNA, 22 bp, Artificial Sequence
  Synthetic Construct
tgaggggccttggggattatga

SEQ ID NO: 39061 - DNA, 22 bp, Artificial Sequence
  Synthetic Construct
ttcagggagctgtccctcatct

SEQ ID NO: 39062 - DNA, 24 bp, Artificial Sequence
  Synthetic Construct
gtgactcgcatagaggatgtttca

SEQ ID NO: 39063 - DNA, 20 bp, Artificial Sequence
  Synthetic Construct
cccaggcaactgcaccaatg

SEQ ID NO: 39064 - DNA, 21 bp, Artificial Sequence
  Synthetic Construct
aagaggggcctctgcttgtag

SEQ ID NO: 39065 - DNA, 19 bp, Artificial Sequence
  Synthetic Construct
agacctcaggccgctcctt

SEQ ID NO: 39066 - DNA, 21 bp, Artificial Sequence
  Synthetic Construct
tggtctcccatccccttcaca

SEQ ID NO: 39067 - DNA, 24 bp, Artificial Sequence
  Synthetic Construct
gggagaaggaagaagaggttccta

SEQ ID NO: 39068 - DNA, 19 bp, Artificial Sequence
  Synthetic Construct
cggcaggcacaggattgaa

SEQ ID NO: 39069 - DNA, 22 bp, Artificial Sequence
  Synthetic Construct
agcagcaactccctccttcttc

SEQ ID NO: 39070 - DNA, 24 bp, Artificial Sequence
  Synthetic Construct
cagcagctctgtgaatttctgtga

SEQ ID NO: 39071 - DNA, 22 bp, Artificial Sequence
  Synthetic Construct
gggtcccaggcaagcagtgtaa

SEQ ID NO: 39072 - DNA, 23 bp, Artificial Sequence
  Synthetic Construct
ccagacagaaaacacctggcatt

SEQ ID NO: 39073 - DNA, 24 bp, Artificial Sequence
  Synthetic Construct
gggtagataacgagagcaggtttg

SEQ ID NO: 39074 - DNA, 23 bp, Artificial Sequence
  Synthetic Construct
ggcacctgtgtgaacatggtagt

SEQ ID NO: 39075 - DNA, 26 bp, Artificial Sequence
  Synthetic Construct
gcataggtctccttctccaagtcgta

SEQ ID NO: 39076 - DNA, 22 bp, Artificial Sequence
  Synthetic Construct
tgctaatgcagggtgggaccta

SEQ ID NO: 39077 - DNA, 22 bp, Artificial Sequence
  Synthetic Construct
aggccctgtttaccccatctga

SEQ ID NO: 39078 - DNA, 22 bp, Artificial Sequence
  Synthetic Construct
caccacatttctgggcctctac

SEQ ID NO: 39079 - DNA, 24 bp, Artificial Sequence
  Synthetic Construct
gggttgaagtggagatcgggaaag

SEQ ID NO: 39080 - DNA, 22 bp, Artificial Sequence
  Synthetic Construct
gcaggaaagcagagtgtcaatg

SEQ ID NO: 39081 - DNA, 22 bp, Artificial Sequence
  Synthetic Construct
ttgatccagctcctgccacttg

SEQ ID NO: 39082 - DNA, 20 bp, Artificial Sequence
  Synthetic Construct
agtagggccacagtgggaat

SEQ ID NO: 39083 - DNA, 22 bp, Artificial Sequence
  Synthetic Construct
tgacactggggagtcctgtagt

SEQ ID NO: 39084 - DNA, 22 bp, Artificial Sequence
  Synthetic Construct
gggagaggagttcaacctgaga

SEQ ID NO: 39085 - DNA, 25 bp, Artificial Sequence
  Synthetic Construct
ccacacttacttttagggctgatct

SEQ ID NO: 39086 - DNA, 22 bp, Artificial Sequence
  Synthetic Construct
ggagtgcgagtccaggaatgtt

SEQ ID NO: 39087 - DNA, 21 bp, Artificial Sequence
  Synthetic Construct
acccctccttggaccatctgt

SEQ ID NO: 39088 - DNA, 20 bp, Artificial Sequence
  Synthetic Construct
atgctaaggcaggcctctgt

SEQ ID NO: 39089 - DNA, 20 bp, Artificial Sequence
  Synthetic Construct
ggatgggagtctgcccttga

SEQ ID NO: 39090 - DNA, 22 bp, Artificial Sequence
  Synthetic Construct
gcacagctcaagggaaggagaa

SEQ ID NO: 39091 - DNA, 20 bp, Artificial Sequence
  Synthetic Construct
ggtccctgcagctttcatca

SEQ ID NO: 39092 - DNA, 22 bp, Artificial Sequence
  Synthetic Construct
ggagctcttccagcctttgagt

SEQ ID NO: 39093 - DNA, 20 bp, Artificial Sequence
  Synthetic Construct
tgtgcagccaactgcgtttc

SEQ ID NO: 39094 - DNA, 25 bp, Artificial Sequence
  Synthetic Construct
aagaacctaccactttcacatccaa

SEQ ID NO: 39095 - DNA, 22 bp, Artificial Sequence
  Synthetic Construct
ttgttttaccctccccttgctt

SEQ ID NO: 39096 - DNA, 22 bp, Artificial Sequence
  Synthetic Construct
cccaggcactggaattctccat

SEQ ID NO: 39097 - DNA, 27 bp, Artificial Sequence
  Synthetic Construct
ggagggattggcatatgtcagtgtaag

SEQ ID NO: 39098 - DNA, 20 bp, Artificial Sequence
  Synthetic Construct
ggctggaagtttgggtgtga

SEQ ID NO: 39099 - DNA, 21 bp, Artificial Sequence
  Synthetic Construct
gctccagagtttcaccacaca

SEQ ID NO: 39100 - DNA, 20 bp, Artificial Sequence
  Synthetic Construct
agcgacagtgcgaggacata

SEQ ID NO: 39101 - DNA, 26 bp, Artificial Sequence
  Synthetic Construct
gtttcccatcgttgatacttgcattc

SEQ ID NO: 39102 - DNA, 24 bp, Artificial Sequence
  Synthetic Construct
ccctcagctcacaagaacctgact

SEQ ID NO: 39103 - DNA, 22 bp, Artificial Sequence
  Synthetic Construct
aggacccctttccctagagttc

SEQ ID NO: 39104 - DNA, 21 bp, Artificial Sequence
  Synthetic Construct
aggacaccaggagcagaccat

SEQ ID NO: 39105 - DNA, 20 bp, Artificial Sequence
  Synthetic Construct
tgtggaacctcccaccacat

SEQ ID NO: 39106 - DNA, 23 bp, Artificial Sequence
  Synthetic Construct
cacaggctggcagttaaaacaga

SEQ ID NO: 39107 - DNA, 25 bp, Artificial Sequence
  Synthetic Construct
aggtttgagaacctccctatgtagt

SEQ ID NO: 39108 - DNA, 23 bp, Artificial Sequence
  Synthetic Construct
cccaggctctagcaaaggtcttc

SEQ ID NO: 39109 - DNA, 26 bp, Artificial Sequence
  Synthetic Construct
ggttacaacagcttgtaggtccttga

SEQ ID NO: 39110 - DNA, 22 bp, Artificial Sequence
  Synthetic Construct
aaaaagagggcctggaatgtga

SEQ ID NO: 39111 - DNA, 22 bp, Artificial Sequence
  Synthetic Construct
agagcctggggaagagaggtta

SEQ ID NO: 39112 - DNA, 26 bp, Artificial Sequence
  Synthetic Construct
cctctgtggaggatagaatggctact

SEQ ID NO: 39113 - DNA, 21 bp, Artificial Sequence
  Synthetic Construct
gccttccaccctgttggattt

SEQ ID NO: 39114 - DNA, 23 bp, Artificial Sequence
  Synthetic Construct
cctgcaaactgcaacagggaatc

SEQ ID NO: 39115 - DNA, 24 bp, Artificial Sequence
  Synthetic Construct
ctggatgctaatgtgcaggagtga

SEQ ID NO: 39116 - DNA, 24 bp, Artificial Sequence
  Synthetic Construct
gggaagagacctagaggagagaca

SEQ ID NO: 39117 - DNA, 22 bp, Artificial Sequence
  Synthetic Construct
gggattcactggctgctgtgat

SEQ ID NO: 39118 - DNA, 20 bp, Artificial Sequence
  Synthetic Construct
ggccttactcccctggtact

SEQ ID NO: 39119 - DNA, 23 bp, Artificial Sequence
  Synthetic Construct
gccaaattctgtgcaggtagaag

SEQ ID NO: 39120 - DNA, 20 bp, Artificial Sequence
  Synthetic Construct
tcacttccaccgctgtgttg

SEQ ID NO: 39121 - DNA, 30 bp, Artificial Sequence
  Synthetic Construct
ccatcagtgtagttcctctaactgtcaaac

SEQ ID NO: 39122 - DNA, 22 bp, Artificial Sequence
  Synthetic Construct
ggccagaagactgcaaaagtca

SEQ ID NO: 39123 - DNA, 20 bp, Artificial Sequence
  Synthetic Construct
ggcaggaaccacctggacaa

SEQ ID NO: 39124 - DNA, 21 bp, Artificial Sequence
  Synthetic Construct
acagcaccagactccgaccaa

SEQ ID NO: 39125 - DNA, 22 bp, Artificial Sequence
  Synthetic Construct
atctgacctcactgctccaatg

SEQ ID NO: 39126 - DNA, 25 bp, Artificial Sequence
  Synthetic Construct
ctggatttcaggctatgtgcctctt

SEQ ID NO: 39127 - DNA, 26 bp, Artificial Sequence
  Synthetic Construct
cagacttaagccagagcaattacaca

SEQ ID NO: 39128 - DNA, 19 bp, Artificial Sequence
  Synthetic Construct
ctgctgtgtgcctgcaatg

SEQ ID NO: 39129 - DNA, 27 bp, Artificial Sequence
  Synthetic Construct
gctccaccatccttaccttaactcgaa

SEQ ID NO: 39130 - DNA, 21 bp, Artificial Sequence
  Synthetic Construct
gaccctcacaccagcaactac

SEQ ID NO: 39131 - DNA, 22 bp, Artificial Sequence
  Synthetic Construct
ggtttccatgccctgactcaac

SEQ ID NO: 39132 - DNA, 21 bp, Artificial Sequence
  Synthetic Construct
ccagaatgccatgggctgtga

SEQ ID NO: 39133 - DNA, 22 bp, Artificial Sequence
  Synthetic Construct
cagcaagtcaaaggcacacagt

SEQ ID NO: 39134 - DNA, 22 bp, Artificial Sequence
  Synthetic Construct
ggccctggggacatacttaatc

SEQ ID NO: 39135 - DNA, 20 bp, Artificial Sequence
  Synthetic Construct
tggctgccgccttcctatca

SEQ ID NO: 39136 - DNA, 21 bp, Artificial Sequence
  Synthetic Construct
gctggaagactgggttggaat

SEQ ID NO: 39137 - DNA, 23 bp, Artificial Sequence
  Synthetic Construct
cgtaggcctggataactccaaga

SEQ ID NO: 39138 - DNA, 22 bp, Artificial Sequence
  Synthetic Construct
cctcccagcaggagattgaaca

SEQ ID NO: 39139 - DNA, 22 bp, Artificial Sequence
  Synthetic Construct
gcaaagcctcttccatctgcat

SEQ ID NO: 39140 - DNA, 24 bp, Artificial Sequence
  Synthetic Construct
gaggcaaaggaagtccagtggata

SEQ ID NO: 39141 - DNA, 20 bp, Artificial Sequence
  Synthetic Construct
gtgggacacagggaacaaca

SEQ ID NO: 39142 - DNA, 22 bp, Artificial Sequence
  Synthetic Construct
cccaccgctggtgtttggaaaa

SEQ ID NO: 39143 - DNA, 20 bp, Artificial Sequence
  Synthetic Construct
ctgcacaggcccagtgattt

SEQ ID NO: 39144 - DNA, 21 bp, Artificial Sequence
  Synthetic Construct
acaccaaccaggaaggtccaa

SEQ ID NO: 39145 - DNA, 20 bp, Artificial Sequence
  Synthetic Construct
tggaaacaggtcccctggaa

SEQ ID NO: 39146 - DNA, 19 bp, Artificial Sequence
  Synthetic Construct
gcacggctgctgggttatg

SEQ ID NO: 39147 - DNA, 22 bp, Artificial Sequence
  Synthetic Construct
ggcatcagcaggggtgatttga

SEQ ID NO: 39148 - DNA, 26 bp, Artificial Sequence
  Synthetic Construct
cctttttctcccaattgctactgtgt

SEQ ID NO: 39149 - DNA, 23 bp, Artificial Sequence
  Synthetic Construct
gtgcaccttctgtgtgtgaatag

SEQ ID NO: 39150 - DNA, 22 bp, Artificial Sequence
  Synthetic Construct
acagagtttggtagcacagcaa

SEQ ID NO: 39151 - DNA, 22 bp, Artificial Sequence
  Synthetic Construct
catgccaatgccttcacctttg

SEQ ID NO: 39152 - DNA, 21 bp, Artificial Sequence
  Synthetic Construct
agggacctcctggtcctgatg

SEQ ID NO: 39153 - DNA, 23 bp, Artificial Sequence
  Synthetic Construct
cagaggtccttcttccccataac

SEQ ID NO: 39154 - DNA, 23 bp, Artificial Sequence
  Synthetic Construct
ggggagagaccaagtctgtctta

SEQ ID NO: 39155 - DNA, 24 bp, Artificial Sequence
  Synthetic Construct
gggtgtgtccatttctgcccaatg

SEQ ID NO: 39156 - DNA, 23 bp, Artificial Sequence
  Synthetic Construct
ggtgggacaggctaaaggcttac

SEQ ID NO: 39157 - DNA, 23 bp, Artificial Sequence
  Synthetic Construct
ggctaagaccctgagctcctaga

SEQ ID NO: 39158 - DNA, 22 bp, Artificial Sequence
  Synthetic Construct
ggacccagaggtgctttcatgt

SEQ ID NO: 39159 - DNA, 18 bp, Artificial Sequence
  Synthetic Construct
tgcagaggagcggcttga

SEQ ID NO: 39160 - DNA, 20 bp, Artificial Sequence
  Synthetic Construct
agttgctggcccaactgtga

SEQ ID NO: 39161 - DNA, 21 bp, Artificial Sequence
  Synthetic Construct
atcgccgccatcgtcttctct

SEQ ID NO: 39162 - DNA, 22 bp, Artificial Sequence
  Synthetic Construct
ccaaaactgaccagctgcctat

SEQ ID NO: 39163 - DNA, 22 bp, Artificial Sequence
  Synthetic Construct
cccagggagtgcgttttctttc

SEQ ID NO: 39164 - DNA, 27 bp, Artificial Sequence
  Synthetic Construct
cgagagcaagagagaaaggaagtctga

SEQ ID NO: 39165 - DNA, 21 bp, Artificial Sequence
  Synthetic Construct
ggaggatcgtgtcccttcact

SEQ ID NO: 39166 - DNA, 25 bp, Artificial Sequence
  Synthetic Construct
ggcattcctcaatagttgcttgaac

SEQ ID NO: 39167 - DNA, 20 bp, Artificial Sequence
  Synthetic Construct
tggcgagcacacctcattgt

SEQ ID NO: 39168 - DNA, 22 bp, Artificial Sequence
  Synthetic Construct
ggttggcttgagctgaggagtt

SEQ ID NO: 39169 - DNA, 25 bp, Artificial Sequence
  Synthetic Construct
ccctgatctaaaccagtgggaggtt

SEQ ID NO: 39170 - DNA, 20 bp, Artificial Sequence
  Synthetic Construct
agttccgggctttgcaccta

SEQ ID NO: 39171 - DNA, 24 bp, Artificial Sequence
  Synthetic Construct
gagagatggtgtgtgtctccatgt

SEQ ID NO: 39172 - DNA, 20 bp, Artificial Sequence
  Synthetic Construct
cctctgccctcaggggtttg

SEQ ID NO: 39173 - DNA, 22 bp, Artificial Sequence
  Synthetic Construct
gccttgctttgggagaacaaac

SEQ ID NO: 39174 - DNA, 22 bp, Artificial Sequence
  Synthetic Construct
ccctctcagcaaggagtgctat

SEQ ID NO: 39175 - DNA, 21 bp, Artificial Sequence
  Synthetic Construct
gtcaacgtcactgcacctgaa

SEQ ID NO: 39176 - DNA, 23 bp, Artificial Sequence
  Synthetic Construct
ggtcgtggacttaacctggaact

SEQ ID NO: 39177 - DNA, 24 bp, Artificial Sequence
  Synthetic Construct
cccaaaactccctgagcacctaac

SEQ ID NO: 39178 - DNA, 27 bp, Artificial Sequence
  Synthetic Construct
cgagttcatgaaaagctaggactcaga

SEQ ID NO: 39179 - DNA, 21 bp, Artificial Sequence
  Synthetic Construct
cagaacaggcagcttggaaac

SEQ ID NO: 39180 - DNA, 22 bp, Artificial Sequence
  Synthetic Construct
cccgtgatgggtaaggcattgt

SEQ ID NO: 39181 - DNA, 23 bp, Artificial Sequence
  Synthetic Construct
gctgagtcagggatgatccgatt

SEQ ID NO: 39182 - DNA, 25 bp, Artificial Sequence
  Synthetic Construct
ttcttgtctccttcaacctaacaca

SEQ ID NO: 39183 - DNA, 22 bp, Artificial Sequence
  Synthetic Construct
gcctttgtcggcagaattggta

SEQ ID NO: 39184 - DNA, 21 bp, Artificial Sequence
  Synthetic Construct
agagggtgggtggggatgata

SEQ ID NO: 39185 - DNA, 20 bp, Artificial Sequence
  Synthetic Construct
tggacacacctgagcagtga

SEQ ID NO: 39186 - DNA, 20 bp, Artificial Sequence
  Synthetic Construct
tgtgcctctgcctctcttct

SEQ ID NO: 39187 - DNA, 22 bp, Artificial Sequence
  Synthetic Construct
gcaaattgcaaaagggcaggat

SEQ ID NO: 39188 - DNA, 25 bp, Artificial Sequence
  Synthetic Construct
gggactctggaggtagtgagtgatg

SEQ ID NO: 39189 - DNA, 19 bp, Artificial Sequence
  Synthetic Construct
acgcctgagctcctggtaa

SEQ ID NO: 39190 - DNA, 26 bp, Artificial Sequence
  Synthetic Construct
cataattagagggcacaatgggtttc

SEQ ID NO: 39191 - DNA, 27 bp, Artificial Sequence
  Synthetic Construct
ggaggttcacttaattgccacatcctt

SEQ ID NO: 39192 - DNA, 27 bp, Artificial Sequence
  Synthetic Construct
ctgtaggtcttatttccagctctgtag

SEQ ID NO: 39193 - DNA, 26 bp, Artificial Sequence
  Synthetic Construct
ccacttttctcccacagccctatact

SEQ ID NO: 39194 - DNA, 26 bp, Artificial Sequence
  Synthetic Construct
gagaggcatacagaagaggtaagtgt

SEQ ID NO: 39195 - DNA, 20 bp, Artificial Sequence
  Synthetic Construct
tctctcccaggcaggtcttt

SEQ ID NO: 39196 - DNA, 22 bp, Artificial Sequence
  Synthetic Construct
gtgctcctgaaccagatgcttt

SEQ ID NO: 39197 - DNA, 22 bp, Artificial Sequence
  Synthetic Construct
tgtccaccacccaagggttttc

SEQ ID NO: 39198 - DNA, 22 bp, Artificial Sequence
  Synthetic Construct
ccagtctctgaggcatgaggat

SEQ ID NO: 39199 - DNA, 26 bp, Artificial Sequence
  Synthetic Construct
ctccaactgcctatttctcctgatac

SEQ ID NO: 39200 - DNA, 22 bp, Artificial Sequence
  Synthetic Construct
ggacagccatctctctgcttca

SEQ ID NO: 39201 - DNA, 23 bp, Artificial Sequence
  Synthetic Construct
tgaatacctagcagcctccttct

SEQ ID NO: 39202 - DNA, 23 bp, Artificial Sequence
  Synthetic Construct
ccagaagaaacccgtctgcttga

SEQ ID NO: 39203 - DNA, 23 bp, Artificial Sequence
  Synthetic Construct
acaaacacatctgagggccaaat

SEQ ID NO: 39204 - DNA, 20 bp, Artificial Sequence
  Synthetic Construct
gggatgaaaggcgactcgat

SEQ ID NO: 39205 - DNA, 23 bp, Artificial Sequence
  Synthetic Construct
gctatctttacgggagcagctaa

SEQ ID NO: 39206 - DNA, 27 bp, Artificial Sequence
  Synthetic Construct
gcctgtagtagattaggcactgtgtag

SEQ ID NO: 39207 - DNA, 19 bp, Artificial Sequence
  Synthetic Construct
cccacctggcccattcctt

SEQ ID NO: 39208 - DNA, 20 bp, Artificial Sequence
  Synthetic Construct
cagtggtggcattggtgaga

SEQ ID NO: 39209 - DNA, 21 bp, Artificial Sequence
  Synthetic Construct
agccacaccccgtatgcatct

SEQ ID NO: 39210 - DNA, 26 bp, Artificial Sequence
  Synthetic Construct
cagcagagagcatagacacaatcctt

SEQ ID NO: 39211 - DNA, 23 bp, Artificial Sequence
  Synthetic Construct
gaggacacactgcagctactaac

SEQ ID NO: 39212 - DNA, 22 bp, Artificial Sequence
  Synthetic Construct
gacaccatcggcagggctataa

SEQ ID NO: 39213 - DNA, 22 bp, Artificial Sequence
  Synthetic Construct
tgggtccaggacagttcctaag

SEQ ID NO: 39214 - DNA, 24 bp, Artificial Sequence
  Synthetic Construct
gagagactttccaagcaggagaca

SEQ ID NO: 39215 - DNA, 20 bp, Artificial Sequence
  Synthetic Construct
atagaggcacagggcgaaga

SEQ ID NO: 39216 - DNA, 20 bp, Artificial Sequence
  Synthetic Construct
actcagggtgcttggagcat

SEQ ID NO: 39217 - DNA, 18 bp, Artificial Sequence
  Synthetic Construct
ttcgggcagcaccagaag

SEQ ID NO: 39218 - DNA, 25 bp, Artificial Sequence
  Synthetic Construct
gattaatcctccctgcctggaattt

SEQ ID NO: 39219 - DNA, 24 bp, Artificial Sequence
  Synthetic Construct
ccatgtgaggacacagcattcatc

SEQ ID NO: 39220 - DNA, 26 bp, Artificial Sequence
  Synthetic Construct
cctctttcttcttcctccaaatccaa

SEQ ID NO: 39221 - DNA, 24 bp, Artificial Sequence
  Synthetic Construct
gacctgattgctcagacagcatga

SEQ ID NO: 39222 - DNA, 26 bp, Artificial Sequence
  Synthetic Construct
gggagtaatgaagccctttcctcttt

SEQ ID NO: 39223 - DNA, 21 bp, Artificial Sequence
  Synthetic Construct
cccaacccctcacacatggaa

SEQ ID NO: 39224 - DNA, 21 bp, Artificial Sequence
  Synthetic Construct
ggcagagaacagcaaatgcaa

SEQ ID NO: 39225 - DNA, 19 bp, Artificial Sequence
  Synthetic Construct
gcaagcaacaggtgcacaa

SEQ ID NO: 39226 - DNA, 21 bp, Artificial Sequence
  Synthetic Construct
caagtccaggctccctgaaac

SEQ ID NO: 39227 - DNA, 21 bp, Artificial Sequence
  Synthetic Construct
gggcgaatcactgggagacaa

SEQ ID NO: 39228 - DNA, 23 bp, Artificial Sequence
  Synthetic Construct
cacacaacctccatgtgggaaca

SEQ ID NO: 39229 - DNA, 23 bp, Artificial Sequence
  Synthetic Construct
tgacgttcagcctaaaagcaaag

SEQ ID NO: 39230 - DNA, 20 bp, Artificial Sequence
  Synthetic Construct
aggcagtgagaagccaccta

SEQ ID NO: 39231 - DNA, 25 bp, Artificial Sequence
  Synthetic Construct
ggaacaaactgtggcaatgcgaatg

SEQ ID NO: 39232 - DNA, 26 bp, Artificial Sequence
  Synthetic Construct
gctatggaacaaaaagacaccaccaa

SEQ ID NO: 39233 - DNA, 22 bp, Artificial Sequence
  Synthetic Construct
tccatcctgaggctccatgctt

SEQ ID NO: 39234 - DNA, 25 bp, Artificial Sequence
  Synthetic Construct
ggctgggtcactttgatctccttat

SEQ ID NO: 39235 - DNA, 27 bp, Artificial Sequence
  Synthetic Construct
ccaggggaagaatgacattgacctttg

SEQ ID NO: 39236 - DNA, 23 bp, Artificial Sequence
  Synthetic Construct
gatcactcttcccactctggttt

SEQ ID NO: 39237 - DNA, 22 bp, Artificial Sequence
  Synthetic Construct
tcacttaggcactcctgggtaa

SEQ ID NO: 39238 - DNA, 22 bp, Artificial Sequence
  Synthetic Construct
tctcagaaaggccttcccttca

SEQ ID NO: 39239 - DNA, 22 bp, Artificial Sequence
  Synthetic Construct
ctggcgcatagggaggttattc

SEQ ID NO: 39240 - DNA, 24 bp, Artificial Sequence
  Synthetic Construct
tctgaagtcagtcagtgtgtgttc

SEQ ID NO: 39241 - DNA, 22 bp, Artificial Sequence
  Synthetic Construct
ccagtgtcaaggctcacctgta

SEQ ID NO: 39242 - DNA, 24 bp, Artificial Sequence
  Synthetic Construct
gagaactgctgctcaagtctaagt

SEQ ID NO: 39243 - DNA, 24 bp, Artificial Sequence
  Synthetic Construct
tccaagccataaatgcactaggat

SEQ ID NO: 39244 - DNA, 20 bp, Artificial Sequence
  Synthetic Construct
agggctgccacagttaggat

SEQ ID NO: 39245 - DNA, 20 bp, Artificial Sequence
  Synthetic Construct
aagggccctgtctcactgaa

SEQ ID NO: 39246 - DNA, 20 bp, Artificial Sequence
  Synthetic Construct
gcagcatctacccggctcat

SEQ ID NO: 39247 - DNA, 20 bp, Artificial Sequence
  Synthetic Construct
tgaccacttcagggccactt

SEQ ID NO: 39248 - DNA, 22 bp, Artificial Sequence
  Synthetic Construct
gccaaaggagccctgttcacat

SEQ ID NO: 39249 - DNA, 27 bp, Artificial Sequence
  Synthetic Construct
gtgagagacaggaagtcaaagggtaaa

SEQ ID NO: 39250 - DNA, 20 bp, Artificial Sequence
  Synthetic Construct
ggctgaggaagcagccctta

SEQ ID NO: 39251 - DNA, 26 bp, Artificial Sequence
  Synthetic Construct
ggtcgttagtcagtctgttgcactac

SEQ ID NO: 39252 - DNA, 22 bp, Artificial Sequence
  Synthetic Construct
ttgcccctctgcctctcctaaa

SEQ ID NO: 39253 - DNA, 22 bp, Artificial Sequence
  Synthetic Construct
cagtgaggagcagatggctaac

SEQ ID NO: 39254 - DNA, 20 bp, Artificial Sequence
  Synthetic Construct
ggtgggctgctgtagcctta

SEQ ID NO: 39255 - DNA, 22 bp, Artificial Sequence
  Synthetic Construct
ccgctggaactgcctgctattt

SEQ ID NO: 39256 - DNA, 20 bp, Artificial Sequence
  Synthetic Construct
acctggatccctggccacat

SEQ ID NO: 39257 - DNA, 22 bp, Artificial Sequence
  Synthetic Construct
gctttcaagcaatcccgtccta

SEQ ID NO: 39258 - DNA, 21 bp, Artificial Sequence
  Synthetic Construct
gtcctgcttgtccttctgctt

SEQ ID NO: 39259 - DNA, 22 bp, Artificial Sequence
  Synthetic Construct
caccttctgtgccactctgtag

SEQ ID NO: 39260 - DNA, 18 bp, Artificial Sequence
  Synthetic Construct
tgcacacgccccgtgata

SEQ ID NO: 39261 - DNA, 21 bp, Artificial Sequence
  Synthetic Construct
gcctgacttgccgatgcttct

SEQ ID NO: 39262 - DNA, 21 bp, Artificial Sequence
  Synthetic Construct
tgcttctgtgggctgggttga

SEQ ID NO: 39263 - DNA, 22 bp, Artificial Sequence
  Synthetic Construct
tgaaacggatcatggctgaaga

SEQ ID NO: 39264 - DNA, 22 bp, Artificial Sequence
  Synthetic Construct
ccttgtagaggggcacaacact

SEQ ID NO: 39265 - DNA, 24 bp, Artificial Sequence
  Synthetic Construct
gctcccctgtagggtagattcaga

SEQ ID NO: 39266 - DNA, 23 bp, Artificial Sequence
  Synthetic Construct
agctgtttttgcaggtgagtgta

SEQ ID NO: 39267 - DNA, 19 bp, Artificial Sequence
  Synthetic Construct
cgggccacaggcaagatgt

SEQ ID NO: 39268 - DNA, 24 bp, Artificial Sequence
  Synthetic Construct
ccagagaagcaacaggaaccatga

SEQ ID NO: 39269 - DNA, 25 bp, Artificial Sequence
  Synthetic Construct
gttttgttagccaagaaagggacat

SEQ ID NO: 39270 - DNA, 22 bp, Artificial Sequence
  Synthetic Construct
ctcattggattgggccctgtaa

SEQ ID NO: 39271 - DNA, 23 bp, Artificial Sequence
  Synthetic Construct
gtggtaaagaaggtggccgaatc

SEQ ID NO: 39272 - DNA, 20 bp, Artificial Sequence
  Synthetic Construct
catcgtctgccggatacaca

SEQ ID NO: 39273 - DNA, 22 bp, Artificial Sequence
  Synthetic Construct
cggcctctgaattttgccatac

SEQ ID NO: 39274 - DNA, 23 bp, Artificial Sequence
  Synthetic Construct
cccagaaagaaggcgaggtgtag

SEQ ID NO: 39275 - DNA, 20 bp, Artificial Sequence
  Synthetic Construct
aacagagcctgcctcccaaa

SEQ ID NO: 39276 - DNA, 24 bp, Artificial Sequence
  Synthetic Construct
ctgctgacttcttaaggcctggat

SEQ ID NO: 39277 - DNA, 23 bp, Artificial Sequence
  Synthetic Construct
gaatcttccccatctcccattgt

SEQ ID NO: 39278 - DNA, 25 bp, Artificial Sequence
  Synthetic Construct
ccctcaccaattcaaggcttccttt

SEQ ID NO: 39279 - DNA, 20 bp, Artificial Sequence
  Synthetic Construct
ggccaagatgccgtctcact

SEQ ID NO: 39280 - DNA, 23 bp, Artificial Sequence
  Synthetic Construct
catcttctcaaagccgaacgaaa

SEQ ID NO: 39281 - DNA, 19 bp, Artificial Sequence
  Synthetic Construct
aagcgaagggcagcagcaa

SEQ ID NO: 39282 - DNA, 23 bp, Artificial Sequence
  Synthetic Construct
ccccttcatcctcatgcctaatg

SEQ ID NO: 39283 - DNA, 24 bp, Artificial Sequence
  Synthetic Construct
ccaagccatggaagtttggggata

SEQ ID NO: 39284 - DNA, 30 bp, Artificial Sequence
  Synthetic Construct
ggatttggactctcttaaaagtgggataac

SEQ ID NO: 39285 - DNA, 19 bp, Artificial Sequence
  Synthetic Construct
aggacagtggcccatggat

SEQ ID NO: 39286 - DNA, 20 bp, Artificial Sequence
  Synthetic Construct
ccacagcctggcaagattca

SEQ ID NO: 39287 - DNA, 21 bp, Artificial Sequence
  Synthetic Construct
ggtcccttgtctggtgtcgtt

SEQ ID NO: 39288 - DNA, 23 bp, Artificial Sequence
  Synthetic Construct
cacagggagcagtgattctcaca

SEQ ID NO: 39289 - DNA, 20 bp, Artificial Sequence
  Synthetic Construct
ttggtgagagctgggaggaa

SEQ ID NO: 39290 - DNA, 20 bp, Artificial Sequence
  Synthetic Construct
ggaaagcagtgcccatcact

SEQ ID NO: 39291 - DNA, 22 bp, Artificial Sequence
  Synthetic Construct
ctgagtcttgttgggagccatt

SEQ ID NO: 39292 - DNA, 24 bp, Artificial Sequence
  Synthetic Construct
cttctctgaaaaggagctggcata

SEQ ID NO: 39293 - DNA, 24 bp, Artificial Sequence
  Synthetic Construct
ggtgttgatagcgagggaggatga

SEQ ID NO: 39294 - DNA, 19 bp, Artificial Sequence
  Synthetic Construct
aaggtgggtcagcctgtgt

SEQ ID NO: 39295 - DNA, 19 bp, Artificial Sequence
  Synthetic Construct
ccctgtgggtgccagacat

SEQ ID NO: 39296 - DNA, 21 bp, Artificial Sequence
  Synthetic Construct
caggcaccaagagcaaacttc

SEQ ID NO: 39297 - DNA, 26 bp, Artificial Sequence
  Synthetic Construct
gggtacaggtgacaattagcctggta

SEQ ID NO: 39298 - DNA, 23 bp, Artificial Sequence
  Synthetic Construct
agaaagtggcaaatggctgtaac

SEQ ID NO: 39299 - DNA, 24 bp, Artificial Sequence
  Synthetic Construct
ctcctagtccagtgctttctcagt

SEQ ID NO: 39300 - DNA, 25 bp, Artificial Sequence
  Synthetic Construct
ggccgtaaataaacctccccatttg

SEQ ID NO: 39301 - DNA, 25 bp, Artificial Sequence
  Synthetic Construct
tgcagactcagtatgaagtcagaac

SEQ ID NO: 39302 - DNA, 20 bp, Artificial Sequence
  Synthetic Construct
accctgggacaaacctgtct

SEQ ID NO: 39303 - DNA, 23 bp, Artificial Sequence
  Synthetic Construct
cccttacacagtgtctgctttga

SEQ ID NO: 39304 - DNA, 22 bp, Artificial Sequence
  Synthetic Construct
ccttcacctgtagggctcaaac

SEQ ID NO: 39305 - DNA, 23 bp, Artificial Sequence
  Synthetic Construct
catgggcttttgtggcttgaatc

SEQ ID NO: 39306 - DNA, 20 bp, Artificial Sequence
  Synthetic Construct
agatgtgtctccccgcatgt

SEQ ID NO: 39307 - DNA, 22 bp, Artificial Sequence
  Synthetic Construct
caccaggcttcaaacacactga

SEQ ID NO: 39308 - DNA, 21 bp, Artificial Sequence
  Synthetic Construct
gtggccctaaagtcaccatgt

SEQ ID NO: 39309 - DNA, 23 bp, Artificial Sequence
  Synthetic Construct
gggaatatggcagcacaggctta

SEQ ID NO: 39310 - DNA, 27 bp, Artificial Sequence
  Synthetic Construct
tttagtagtagctcagagtggatgaac

SEQ ID NO: 39311 - DNA, 20 bp, Artificial Sequence
  Synthetic Construct
acaggctctgctccactaga

SEQ ID NO: 39312 - DNA, 20 bp, Artificial Sequence
  Synthetic Construct
gcaaggctgatgcctgatct

SEQ ID NO: 39313 - DNA, 22 bp, Artificial Sequence
  Synthetic Construct
tcacatgggcatgttgtgtgat

SEQ ID NO: 39314 - DNA, 21 bp, Artificial Sequence
  Synthetic Construct
tacccgaggctggggaaagaa

SEQ ID NO: 39315 - DNA, 22 bp, Artificial Sequence
  Synthetic Construct
gggctggtctagatgcttcctt

SEQ ID NO: 39316 - DNA, 26 bp, Artificial Sequence
  Synthetic Construct
gtgacttcctgaggttctatgcctaa

SEQ ID NO: 39317 - DNA, 20 bp, Artificial Sequence
  Synthetic Construct
ggccagcgtagagctaccaa

SEQ ID NO: 39318 - DNA, 23 bp, Artificial Sequence
  Synthetic Construct
tgtctggtatgcaactgtgaact

SEQ ID NO: 39319 - DNA, 21 bp, Artificial Sequence
  Synthetic Construct
tgggctagggaatggggattg

SEQ ID NO: 39320 - DNA, 27 bp, Artificial Sequence
  Synthetic Construct
gcagaaaagagtaaacagccagcacta

SEQ ID NO: 39321 - DNA, 24 bp, Artificial Sequence
  Synthetic Construct
tcagtgtggacatggaaagagaaa

SEQ ID NO: 39322 - DNA, 24 bp, Artificial Sequence
  Synthetic Construct
ggcttcaagaaagggaagcgtact

SEQ ID NO: 39323 - DNA, 20 bp, Artificial Sequence
  Synthetic Construct
ctccagctcctgctttggaa

SEQ ID NO: 39324 - DNA, 22 bp, Artificial Sequence
  Synthetic Construct
cctttcccttgagtccctctct

SEQ ID NO: 39325 - DNA, 22 bp, Artificial Sequence
  Synthetic Construct
caccactggctcgtagtgtgaa

SEQ ID NO: 39326 - DNA, 23 bp, Artificial Sequence
  Synthetic Construct
ctggacttcaggcttggactaga

SEQ ID NO: 39327 - DNA, 20 bp, Artificial Sequence
  Synthetic Construct
tggaacaaggcaggttgctt

SEQ ID NO: 39328 - DNA, 23 bp, Artificial Sequence
  Synthetic Construct
gcaaccggtcgaatatgctctga

SEQ ID NO: 39329 - DNA, 24 bp, Artificial Sequence
  Synthetic Construct
ggacagaagagctgtccccatact

SEQ ID NO: 39330 - DNA, 21 bp, Artificial Sequence
  Synthetic Construct
ggctgtgcttgtcttcagcta

SEQ ID NO: 39331 - DNA, 23 bp, Artificial Sequence
  Synthetic Construct
cacaatgttccgagttgcctttc

SEQ ID NO: 39332 - DNA, 25 bp, Artificial Sequence
  Synthetic Construct
cccaccaccatggactaaagggtta

SEQ ID NO: 39333 - DNA, 30 bp, Artificial Sequence
  Synthetic Construct
cccatgtatctcttctggtaacctactaag

SEQ ID NO: 39334 - DNA, 19 bp, Artificial Sequence
  Synthetic Construct
gagttcccctgccgacttg

SEQ ID NO: 39335 - DNA, 26 bp, Artificial Sequence
  Synthetic Construct
ggccctcagagatctgtattccctta

SEQ ID NO: 39336 - DNA, 19 bp, Artificial Sequence
  Synthetic Construct
tgggcgagcacttgctact

SEQ ID NO: 39337 - DNA, 26 bp, Artificial Sequence
  Synthetic Construct
ggggacatgtttgatgtccagacaga

SEQ ID NO: 39338 - DNA, 25 bp, Artificial Sequence
  Synthetic Construct
gcttttactccctgtgtttttggaa

SEQ ID NO: 39339 - DNA, 24 bp, Artificial Sequence
  Synthetic Construct
gggtctagacaggcctgagttcta

SEQ ID NO: 39340 - DNA, 22 bp, Artificial Sequence
  Synthetic Construct
agaaagaggtgggatggaggat

SEQ ID NO: 39341 - DNA, 22 bp, Artificial Sequence
  Synthetic Construct
gagtgtcagttgtgtcccagaa

SEQ ID NO: 39342 - DNA, 22 bp, Artificial Sequence
  Synthetic Construct
ggcgggaccagtagtcttgttt

SEQ ID NO: 39343 - DNA, 22 bp, Artificial Sequence
  Synthetic Construct
gtgcacatgctctccctagaca

SEQ ID NO: 39344 - DNA, 23 bp, Artificial Sequence
  Synthetic Construct
ccgtaaaccaagtggggatgtag

SEQ ID NO: 39345 - DNA, 23 bp, Artificial Sequence
  Synthetic Construct
cctcagtctgtgctggtaagaga

SEQ ID NO: 39346 - DNA, 27 bp, Artificial Sequence
  Synthetic Construct
ctcaacatggaattaagttgcctcctt

SEQ ID NO: 39347 - DNA, 26 bp, Artificial Sequence
  Synthetic Construct
actcttatctaggattctgggccatt

SEQ ID NO: 39348 - DNA, 19 bp, Artificial Sequence
  Synthetic Construct
ttggtccccgttgttgcat

SEQ ID NO: 39349 - DNA, 22 bp, Artificial Sequence
  Synthetic Construct
gactggcactcctgaggaaaga

SEQ ID NO: 39350 - DNA, 20 bp, Artificial Sequence
  Synthetic Construct
cctggggaggagggagatga

SEQ ID NO: 39351 - DNA, 22 bp, Artificial Sequence
  Synthetic Construct
cagaacagcagttttgcaccaa

SEQ ID NO: 39352 - DNA, 22 bp, Artificial Sequence
  Synthetic Construct
ggatgcactggctctgcagttt

SEQ ID NO: 39353 - DNA, 22 bp, Artificial Sequence
  Synthetic Construct
ctcttggattcacggccagatg

SEQ ID NO: 39354 - DNA, 27 bp, Artificial Sequence
  Synthetic Construct
ggacatgattggtttcactgtggagtt

SEQ ID NO: 39355 - DNA, 22 bp, Artificial Sequence
  Synthetic Construct
acctatccttgacgtgggaagt

SEQ ID NO: 39356 - DNA, 20 bp, Artificial Sequence
  Synthetic Construct
cctgcagcagcgacaatgaa

SEQ ID NO: 39357 - DNA, 25 bp, Artificial Sequence
  Synthetic Construct
cctaaagggaaaaatgcagtgttga

SEQ ID NO: 39358 - DNA, 23 bp, Artificial Sequence
  Synthetic Construct
ggcctaagtcagggttctgcaat

SEQ ID NO: 39359 - DNA, 20 bp, Artificial Sequence
  Synthetic Construct
agtgctcaccccttccactt

SEQ ID NO: 39360 - DNA, 25 bp, Artificial Sequence
  Synthetic Construct
cataactacactgcattcccactca

SEQ ID NO: 39361 - DNA, 27 bp, Artificial Sequence
  Synthetic Construct
ggaactcagcttttcattgtggggaaa

SEQ ID NO: 39362 - DNA, 22 bp, Artificial Sequence
  Synthetic Construct
aaacctgctgacagggtaaaca

SEQ ID NO: 39363 - DNA, 24 bp, Artificial Sequence
  Synthetic Construct
cccgtgcttctaacagattggaaa

SEQ ID NO: 39364 - DNA, 24 bp, Artificial Sequence
  Synthetic Construct
ccaagcaccaaggacatcctcaga

SEQ ID NO: 39365 - DNA, 22 bp, Artificial Sequence
  Synthetic Construct
ttgggttgagatccagcagatg

SEQ ID NO: 39366 - DNA, 23 bp, Artificial Sequence
  Synthetic Construct
ggtgcttacatggttctgagcaa

SEQ ID NO: 39367 - DNA, 25 bp, Artificial Sequence
  Synthetic Construct
ctgggataagagctagagtgctaag

SEQ ID NO: 39368 - DNA, 28 bp, Artificial Sequence
  Synthetic Construct
gacttaagaaggcattaccagctactga

SEQ ID NO: 39369 - DNA, 21 bp, Artificial Sequence
  Synthetic Construct
ctggccacaccaagaatggtt

SEQ ID NO: 39370 - DNA, 22 bp, Artificial Sequence
  Synthetic Construct
ccagctgccagaggtttcacat

SEQ ID NO: 39371 - DNA, 28 bp, Artificial Sequence
  Synthetic Construct
ggttggaatatgaatgtggaggggatga

SEQ ID NO: 39372 - DNA, 25 bp, Artificial Sequence
  Synthetic Construct
ataccaaaggctgttcttcaacaag

SEQ ID NO: 39373 - DNA, 24 bp, Artificial Sequence
  Synthetic Construct
tcccactcactttccaggattaga

SEQ ID NO: 39374 - DNA, 20 bp, Artificial Sequence
  Synthetic Construct
atgcatcccgccaagtcagt

SEQ ID NO: 39375 - DNA, 23 bp, Artificial Sequence
  Synthetic Construct
tgccatttttgctcctctctttg

SEQ ID NO: 39376 - DNA, 22 bp, Artificial Sequence
  Synthetic Construct
cactgcatccactctcgtgtct

SEQ ID NO: 39377 - DNA, 20 bp, Artificial Sequence
  Synthetic Construct
tccttgaagcccacatgcaa

SEQ ID NO: 39378 - DNA, 22 bp, Artificial Sequence
  Synthetic Construct
tgaggaccgagattttgccttt

SEQ ID NO: 39379 - DNA, 27 bp, Artificial Sequence
  Synthetic Construct
gcattagtactgcagagataccgatac

SEQ ID NO: 39380 - DNA, 20 bp, Artificial Sequence
  Synthetic Construct
atggtctggctgcctgttct

SEQ ID NO: 39381 - DNA, 20 bp, Artificial Sequence
  Synthetic Construct
aggcccagcttagctcttca

SEQ ID NO: 39382 - DNA, 24 bp, Artificial Sequence
  Synthetic Construct
tctgggaccaaagtgaacctaaag

SEQ ID NO: 39383 - DNA, 26 bp, Artificial Sequence
  Synthetic Construct
ggttcagaaaatggcccttcctttag

SEQ ID NO: 39384 - DNA, 20 bp, Artificial Sequence
  Synthetic Construct
tgcacaggctgcagcataac

SEQ ID NO: 39385 - DNA, 23 bp, Artificial Sequence
  Synthetic Construct
ccacccaggctgaggtcattaag

SEQ ID NO: 39386 - DNA, 23 bp, Artificial Sequence
  Synthetic Construct
cgggaccttgatttcggagatag

SEQ ID NO: 39387 - DNA, 25 bp, Artificial Sequence
  Synthetic Construct
gggagtagacacataccctctcttc

SEQ ID NO: 39388 - DNA, 28 bp, Artificial Sequence
  Synthetic Construct
cctctggattaggtaatgaggcagagaa

SEQ ID NO: 39389 - DNA, 27 bp, Artificial Sequence
  Synthetic Construct
gctaagcatgtcagaattccaggtctt

SEQ ID NO: 39390 - DNA, 19 bp, Artificial Sequence
  Synthetic Construct
agccgtcatccagccaagt

SEQ ID NO: 39391 - DNA, 20 bp, Artificial Sequence
  Synthetic Construct
cccagtttccaggggtgtgt

SEQ ID NO: 39392 - DNA, 24 bp, Artificial Sequence
  Synthetic Construct
gactaagtgtgttgcctctgtttg

SEQ ID NO: 39393 - DNA, 24 bp, Artificial Sequence
  Synthetic Construct
ggcataggtttgacaggagtgtta

SEQ ID NO: 39394 - DNA, 27 bp, Artificial Sequence
  Synthetic Construct
gagaattatacatcactggctctctga

SEQ ID NO: 39395 - DNA, 21 bp, Artificial Sequence
  Synthetic Construct
agcatgcatgtggctctcaaa

SEQ ID NO: 39396 - DNA, 22 bp, Artificial Sequence
  Synthetic Construct
acaagccccatatctgcctact

SEQ ID NO: 39397 - DNA, 24 bp, Artificial Sequence
  Synthetic Construct
gccttcccatctgtgagcttgttc

SEQ ID NO: 39398 - DNA, 25 bp, Artificial Sequence
  Synthetic Construct
ctgcagtcagacattgcaaagagtt

SEQ ID NO: 39399 - DNA, 20 bp, Artificial Sequence
  Synthetic Construct
gggtgagggcatgggacttc

SEQ ID NO: 39400 - DNA, 22 bp, Artificial Sequence
  Synthetic Construct
ggtcccacatggctcttccaaa

SEQ ID NO: 39401 - DNA, 24 bp, Artificial Sequence
  Synthetic Construct
ggagctaaagggactgcaggatac

SEQ ID NO: 39402 - DNA, 25 bp, Artificial Sequence
  Synthetic Construct
tgccaacaaccactagaaattggat

SEQ ID NO: 39403 - DNA, 26 bp, Artificial Sequence
  Synthetic Construct
ctgatatccaaatcgatgccaactct

SEQ ID NO: 39404 - DNA, 21 bp, Artificial Sequence
  Synthetic Construct
gcgtgattaggactggctaca

SEQ ID NO: 39405 - DNA, 26 bp, Artificial Sequence
  Synthetic Construct
ggaggagaggagagatggatggattc

SEQ ID NO: 39406 - DNA, 22 bp, Artificial Sequence
  Synthetic Construct
ttccccaagatgcctctagact

SEQ ID NO: 39407 - DNA, 21 bp, Artificial Sequence
  Synthetic Construct
tggattcagccggacttgatg

SEQ ID NO: 39408 - DNA, 23 bp, Artificial Sequence
  Synthetic Construct
ctctcagtgacttcgcacaagtt

SEQ ID NO: 39409 - DNA, 20 bp, Artificial Sequence
  Synthetic Construct
gtcacgcagcacagaggaaa

SEQ ID NO: 39410 - DNA, 21 bp, Artificial Sequence
  Synthetic Construct
agtagagagccagtgggaaca

SEQ ID NO: 39411 - DNA, 20 bp, Artificial Sequence
  Synthetic Construct
acgtgttggctggagcatgt

SEQ ID NO: 39412 - DNA, 24 bp, Artificial Sequence
  Synthetic Construct
ggcaacattttccaacacccaact

SEQ ID NO: 39413 - DNA, 18 bp, Artificial Sequence
  Synthetic Construct
actcgggcgtggaactgt

SEQ ID NO: 39414 - DNA, 21 bp, Artificial Sequence
  Synthetic Construct
aggggtacccattctgcatgt

SEQ ID NO: 39415 - DNA, 22 bp, Artificial Sequence
  Synthetic Construct
tctccagctgggtgtctctatc

SEQ ID NO: 39416 - DNA, 23 bp, Artificial Sequence
  Synthetic Construct
aattccctcatctggggctttag

SEQ ID NO: 39417 - DNA, 23 bp, Artificial Sequence
  Synthetic Construct
gaggtctcccaaacacctacaga

SEQ ID NO: 39418 - DNA, 24 bp, Artificial Sequence
  Synthetic Construct
agcactcaataaactcagctgcta

SEQ ID NO: 39419 - DNA, 26 bp, Artificial Sequence
  Synthetic Construct
cagttaggaccacaatcaaaccatac

SEQ ID NO: 39420 - DNA, 22 bp, Artificial Sequence
  Synthetic Construct
gtcctctcggcccacttaattc

SEQ ID NO: 39421 - DNA, 24 bp, Artificial Sequence
  Synthetic Construct
ccactggcttctgggaatttctac

SEQ ID NO: 39422 - DNA, 21 bp, Artificial Sequence
  Synthetic Construct
accagatggcattggggattc

SEQ ID NO: 39423 - DNA, 21 bp, Artificial Sequence
  Synthetic Construct
cccctgctccaaacacaccat

SEQ ID NO: 39424 - DNA, 20 bp, Artificial Sequence
  Synthetic Construct
tttgtggttgccgccctttg

SEQ ID NO: 39425 - DNA, 27 bp, Artificial Sequence
  Synthetic Construct
caaggataactttccactctgcttttg

SEQ ID NO: 39426 - DNA, 22 bp, Artificial Sequence
  Synthetic Construct
cggagagccatctgccatatct

SEQ ID NO: 39427 - DNA, 21 bp, Artificial Sequence
  Synthetic Construct
cgcctcttaagccaagggaat

SEQ ID NO: 39428 - DNA, 22 bp, Artificial Sequence
  Synthetic Construct
caaatcccgccgagtgatctta

SEQ ID NO: 39429 - DNA, 27 bp, Artificial Sequence
  Synthetic Construct
tttcctagatagaatcctggggtatgt

SEQ ID NO: 39430 - DNA, 22 bp, Artificial Sequence
  Synthetic Construct
aagacacaacgaggctaaccaa

SEQ ID NO: 39431 - DNA, 24 bp, Artificial Sequence
  Synthetic Construct
gtgaagcatttccagcttgcatca

SEQ ID NO: 39432 - DNA, 20 bp, Artificial Sequence
  Synthetic Construct
ttgacagcggcttcctgatg

SEQ ID NO: 39433 - DNA, 24 bp, Artificial Sequence
  Synthetic Construct
ggatcaggtttgccatcctctact

SEQ ID NO: 39434 - DNA, 23 bp, Artificial Sequence
  Synthetic Construct
gctgcttttcagaactgctctct

SEQ ID NO: 39435 - DNA, 20 bp, Artificial Sequence
  Synthetic Construct
agggcactccagaagcagtt

SEQ ID NO: 39436 - DNA, 20 bp, Artificial Sequence
  Synthetic Construct
gagcatcggcgaagcactaa

SEQ ID NO: 39437 - DNA, 20 bp, Artificial Sequence
  Synthetic Construct
tcccagctgctccttagctt

SEQ ID NO: 39438 - DNA, 22 bp, Artificial Sequence
  Synthetic Construct
ttggccaatggaatcacagagt

SEQ ID NO: 39439 - DNA, 24 bp, Artificial Sequence
  Synthetic Construct
ggacagcaaagagtccaagcagat

SEQ ID NO: 39440 - DNA, 20 bp, Artificial Sequence
  Synthetic Construct
ttcccagcgagaacgaccat

SEQ ID NO: 39441 - DNA, 29 bp, Artificial Sequence
  Synthetic Construct
cagacttcaattgcctatgtcacttctct

SEQ ID NO: 39442 - DNA, 22 bp, Artificial Sequence
  Synthetic Construct
tgggactgtgaggccagaaatg

SEQ ID NO: 39443 - DNA, 27 bp, Artificial Sequence
  Synthetic Construct
tctaagtcctgtcttgcattagagttg

SEQ ID NO: 39444 - DNA, 22 bp, Artificial Sequence
  Synthetic Construct
accgggacacccataggcaata

SEQ ID NO: 39445 - DNA, 24 bp, Artificial Sequence
  Synthetic Construct
cgtcacattacacctcctgtcact

SEQ ID NO: 39446 - DNA, 23 bp, Artificial Sequence
  Synthetic Construct
gtggtgtctacagtgtgctggtt

SEQ ID NO: 39447 - DNA, 29 bp, Artificial Sequence
  Synthetic Construct
ccactcctcattaaaagcaaacacagctt

SEQ ID NO: 39448 - DNA, 26 bp, Artificial Sequence
  Synthetic Construct
cctttacttgtgtgaagtcagtgttc

SEQ ID NO: 39449 - DNA, 22 bp, Artificial Sequence
  Synthetic Construct
gaccagaacagggacctctcta

SEQ ID NO: 39450 - DNA, 19 bp, Artificial Sequence
  Synthetic Construct
acacccgcaaaagccagat

SEQ ID NO: 39451 - DNA, 20 bp, Artificial Sequence
  Synthetic Construct
acagaggccccaggcttcat

SEQ ID NO: 39452 - DNA, 25 bp, Artificial Sequence
  Synthetic Construct
cccactcggttacaatttgttggtt

SEQ ID NO: 39453 - DNA, 22 bp, Artificial Sequence
  Synthetic Construct
ggggtcgatttggtagccttag

SEQ ID NO: 39454 - DNA, 24 bp, Artificial Sequence
  Synthetic Construct
gacaaagttagcaggtagcgaatc

SEQ ID NO: 39455 - DNA, 24 bp, Artificial Sequence
  Synthetic Construct
aatgttggaaccaatgtccctttg

SEQ ID NO: 39456 - DNA, 22 bp, Artificial Sequence
  Synthetic Construct
ctgagattcccacagcaacact

SEQ ID NO: 39457 - DNA, 22 bp, Artificial Sequence
  Synthetic Construct
tcccttacctccacccaacact

SEQ ID NO: 39458 - DNA, 22 bp, Artificial Sequence
  Synthetic Construct
gccagcagacttgccttctttg

SEQ ID NO: 39459 - DNA, 20 bp, Artificial Sequence
  Synthetic Construct
cctgtcactgcttggcatgt

SEQ ID NO: 39460 - DNA, 21 bp, Artificial Sequence
  Synthetic Construct
tggtggatgggcgggactaat

SEQ ID NO: 39461 - DNA, 20 bp, Artificial Sequence
  Synthetic Construct
acagcctacaccgcgttttc

SEQ ID NO: 39462 - DNA, 22 bp, Artificial Sequence
  Synthetic Construct
ggtggaaaggcttgcgacattc

SEQ ID NO: 39463 - DNA, 25 bp, Artificial Sequence
  Synthetic Construct
ggaagcagaacctagaactgtccat

SEQ ID NO: 39464 - DNA, 28 bp, Artificial Sequence
  Synthetic Construct
ggttctgaatgggctgtgtcttacttat

SEQ ID NO: 39465 - DNA, 26 bp, Artificial Sequence
  Synthetic Construct
gtgcagctgaagtaaagtaacctaga

SEQ ID NO: 39466 - DNA, 21 bp, Artificial Sequence
  Synthetic Construct
ctctgttcggtgagagcaact

SEQ ID NO: 39467 - DNA, 21 bp, Artificial Sequence
  Synthetic Construct
gacatttggtgcagctgtgtt

SEQ ID NO: 39468 - DNA, 25 bp, Artificial Sequence
  Synthetic Construct
cactccatcctctccttccatctga

SEQ ID NO: 39469 - DNA, 24 bp, Artificial Sequence
  Synthetic Construct
actgtaactcagttgcctctttca

SEQ ID NO: 39470 - DNA, 21 bp, Artificial Sequence
  Synthetic Construct
tccaccctccagcctgacaat

SEQ ID NO: 39471 - DNA, 20 bp, Artificial Sequence
  Synthetic Construct
tggaagtgggaggggacaca

SEQ ID NO: 39472 - DNA, 21 bp, Artificial Sequence
  Synthetic Construct
tgccgtgaaacctccatttct

SEQ ID NO: 39473 - DNA, 24 bp, Artificial Sequence
  Synthetic Construct
gggagagacagctaagtccctaag

SEQ ID NO: 39474 - DNA, 20 bp, Artificial Sequence
  Synthetic Construct
acacagggctgcagtgttca

SEQ ID NO: 39475 - DNA, 22 bp, Artificial Sequence
  Synthetic Construct
ctcataaagctggccctggatt

SEQ ID NO: 39476 - DNA, 24 bp, Artificial Sequence
  Synthetic Construct
cccgaggagctcagttgtatggtt

SEQ ID NO: 39477 - DNA, 30 bp, Artificial Sequence
  Synthetic Construct
gacaacccagtaaagttgtttctcacattg

SEQ ID NO: 39478 - DNA, 24 bp, Artificial Sequence
  Synthetic Construct
gtccagtgggtgaatggcctataa

SEQ ID NO: 39479 - DNA, 21 bp, Artificial Sequence
  Synthetic Construct
gccttggatgaagctgccttt

SEQ ID NO: 39480 - DNA, 21 bp, Artificial Sequence
  Synthetic Construct
aggaaccagtggctgccatca

SEQ ID NO: 39481 - DNA, 24 bp, Artificial Sequence
  Synthetic Construct
gctggtaagtctctgccgatcaac

SEQ ID NO: 39482 - DNA, 22 bp, Artificial Sequence
  Synthetic Construct
tggctgaggaggggacatgtta

SEQ ID NO: 39483 - DNA, 21 bp, Artificial Sequence
  Synthetic Construct
gcaggtggggtacaccatgaa

SEQ ID NO: 39484 - DNA, 20 bp, Artificial Sequence
  Synthetic Construct
aacgcaggtctggctgattc

SEQ ID NO: 39485 - DNA, 19 bp, Artificial Sequence
  Synthetic Construct
gctggttgggtgacagcaa

SEQ ID NO: 39486 - DNA, 25 bp, Artificial Sequence
  Synthetic Construct
gagttttcataccaccgtagaccat

SEQ ID NO: 39487 - DNA, 27 bp, Artificial Sequence
  Synthetic Construct
gtggatcatgttataggatggggtcat

SEQ ID NO: 39488 - DNA, 25 bp, Artificial Sequence
  Synthetic Construct
ttggccaactgtaacatgtagtttc

SEQ ID NO: 39489 - DNA, 20 bp, Artificial Sequence
  Synthetic Construct
aggccagggtgctctgttga

SEQ ID NO: 39490 - DNA, 23 bp, Artificial Sequence
  Synthetic Construct
gtagacagagcatccctggtttc

SEQ ID NO: 39491 - DNA, 20 bp, Artificial Sequence
  Synthetic Construct
ggggcttccacagcttcttt

SEQ ID NO: 39492 - DNA, 18 bp, Artificial Sequence
  Synthetic Construct
tggctcgcgatgccttct

SEQ ID NO: 39493 - DNA, 23 bp, Artificial Sequence
  Synthetic Construct
cttgcagctacatcaaggggaaa

SEQ ID NO: 39494 - DNA, 22 bp, Artificial Sequence
  Synthetic Construct
ggtttctagccccagcttgtgt

SEQ ID NO: 39495 - DNA, 22 bp, Artificial Sequence
  Synthetic Construct
cttgcctccttgctcaagaaac

SEQ ID NO: 39496 - DNA, 22 bp, Artificial Sequence
  Synthetic Construct
agtgagagtctctgggaaccaa

SEQ ID NO: 39497 - DNA, 22 bp, Artificial Sequence
  Synthetic Construct
ctgtacccagctcaaagtcagt

SEQ ID NO: 39498 - DNA, 22 bp, Artificial Sequence
  Synthetic Construct
cccttccacttcctcgcttagt

SEQ ID NO: 39499 - DNA, 23 bp, Artificial Sequence
  Synthetic Construct
ccaagatacaccttgcccctctt

SEQ ID NO: 39500 - DNA, 22 bp, Artificial Sequence
  Synthetic Construct
gcaccctggaacttggtcaatc

SEQ ID NO: 39501 - DNA, 30 bp, Artificial Sequence
  Synthetic Construct
gagaaatatcttaaggctcgtgttctgtca

SEQ ID NO: 39502 - DNA, 22 bp, Artificial Sequence
  Synthetic Construct
ctttctcccaagcaaggaggat

SEQ ID NO: 39503 - DNA, 22 bp, Artificial Sequence
  Synthetic Construct
cacccaatgttcaccccaaagt

SEQ ID NO: 39504 - DNA, 25 bp, Artificial Sequence
  Synthetic Construct
tgtatagacctggagtacacagtca

SEQ ID NO: 39505 - DNA, 24 bp, Artificial Sequence
  Synthetic Construct
gcagctaggcaagaggatgagaag

SEQ ID NO: 39506 - DNA, 25 bp, Artificial Sequence
  Synthetic Construct
gcataaacccaggtccctttaggtt

SEQ ID NO: 39507 - DNA, 22 bp, Artificial Sequence
  Synthetic Construct
ccacagcagccactgttctttc

SEQ ID NO: 39508 - DNA, 20 bp, Artificial Sequence
  Synthetic Construct
tcgtctctatgggccgcaat

SEQ ID NO: 39509 - DNA, 23 bp, Artificial Sequence
  Synthetic Construct
ctgcaagcatgcactcatagaga

SEQ ID NO: 39510 - DNA, 23 bp, Artificial Sequence
  Synthetic Construct
ggggatacttggtaggacacact

SEQ ID NO: 39511 - DNA, 25 bp, Artificial Sequence
  Synthetic Construct
ggatagcaaatacactgcagcacaa

SEQ ID NO: 39512 - DNA, 23 bp, Artificial Sequence
  Synthetic Construct
cccttttgaggtgtccttactgt

SEQ ID NO: 39513 - DNA, 22 bp, Artificial Sequence
  Synthetic Construct
cacatggaacagagccatggaa

SEQ ID NO: 39514 - DNA, 23 bp, Artificial Sequence
  Synthetic Construct
gggaaaggtacagcacgtttatg

SEQ ID NO: 39515 - DNA, 24 bp, Artificial Sequence
  Synthetic Construct
ctgaccacacaacctctgttggaa

SEQ ID NO: 39516 - DNA, 25 bp, Artificial Sequence
  Synthetic Construct
gtggaacgtgtctaattccctcaca

SEQ ID NO: 39517 - DNA, 23 bp, Artificial Sequence
  Synthetic Construct
gctgagataggaacgctgtcagt

SEQ ID NO: 39518 - DNA, 24 bp, Artificial Sequence
  Synthetic Construct
tgacagcagtatccagagacttga

SEQ ID NO: 39519 - DNA, 21 bp, Artificial Sequence
  Synthetic Construct
acaggatgaacaaggcggatt

SEQ ID NO: 39520 - DNA, 25 bp, Artificial Sequence
  Synthetic Construct
gacatgaaggtaagagcaagtcaac

SEQ ID NO: 39521 - DNA, 29 bp, Artificial Sequence
  Synthetic Construct
gacattacctaatcagagcatcagcttct

SEQ ID NO: 39522 - DNA, 21 bp, Artificial Sequence
  Synthetic Construct
gggaaggtggcaaagacttgt

SEQ ID NO: 39523 - DNA, 21 bp, Artificial Sequence
  Synthetic Construct
ccactgggtccagttgtggat

SEQ ID NO: 39524 - DNA, 24 bp, Artificial Sequence
  Synthetic Construct
aagttgtctgtccacttccctaag

SEQ ID NO: 39525 - DNA, 27 bp, Artificial Sequence
  Synthetic Construct
ggaagtttttgcagtagtgggtctaac

SEQ ID NO: 39526 - DNA, 21 bp, Artificial Sequence
  Synthetic Construct
ggctgcattacagaccactga

SEQ ID NO: 39527 - DNA, 23 bp, Artificial Sequence
  Synthetic Construct
gggacttgtctactccagagtgt

SEQ ID NO: 39528 - DNA, 25 bp, Artificial Sequence
  Synthetic Construct
gtgaacatggctctcaggagacttt

SEQ ID NO: 39529 - DNA, 22 bp, Artificial Sequence
  Synthetic Construct
tgtctccccagtttggggctta

SEQ ID NO: 39530 - DNA, 21 bp, Artificial Sequence
  Synthetic Construct
tgccaccacacctggttccta

SEQ ID NO: 39531 - DNA, 22 bp, Artificial Sequence
  Synthetic Construct
acgaacccatgctgggaatatg

SEQ ID NO: 39532 - DNA, 23 bp, Artificial Sequence
  Synthetic Construct
gcagggagaagaggaaaggttca

SEQ ID NO: 39533 - DNA, 23 bp, Artificial Sequence
  Synthetic Construct
cagccaatgttccagaacgctaa

SEQ ID NO: 39534 - DNA, 21 bp, Artificial Sequence
  Synthetic Construct
tccctcacccctctactggaa

SEQ ID NO: 39535 - DNA, 25 bp, Artificial Sequence
  Synthetic Construct
gggatgtcagggaacaaaagcaatc

SEQ ID NO: 39536 - DNA, 22 bp, Artificial Sequence
  Synthetic Construct
ccagtgggtggagatgctaaga

SEQ ID NO: 39537 - DNA, 26 bp, Artificial Sequence
  Synthetic Construct
ccagatgcccacttgataacaacaca

SEQ ID NO: 39538 - DNA, 19 bp, Artificial Sequence
  Synthetic Construct
agcccctctggacctcagt

SEQ ID NO: 39539 - DNA, 20 bp, Artificial Sequence
  Synthetic Construct
acaacccctgtgggctccaa

SEQ ID NO: 39540 - DNA, 23 bp, Artificial Sequence
  Synthetic Construct
ttctgtaaggggcacatggatac

SEQ ID NO: 39541 - DNA, 19 bp, Artificial Sequence
  Synthetic Construct
ggggccatcaggactggaa

SEQ ID NO: 39542 - DNA, 20 bp, Artificial Sequence
  Synthetic Construct
acctctgtggggcgtgtcaa

SEQ ID NO: 39543 - DNA, 26 bp, Artificial Sequence
  Synthetic Construct
cctttacatttctccagtaggtcaca

SEQ ID NO: 39544 - DNA, 27 bp, Artificial Sequence
  Synthetic Construct
cctcaaagtctagcaatcagtgggtat

SEQ ID NO: 39545 - DNA, 21 bp, Artificial Sequence
  Synthetic Construct
agctacgagctgaggatcaca

SEQ ID NO: 39546 - DNA, 23 bp, Artificial Sequence
  Synthetic Construct
gtgtgtttgctgtgaggctacaa

SEQ ID NO: 39547 - DNA, 30 bp, Artificial Sequence
  Synthetic Construct
ccctgtcttttaaaaccttaccatcagttc

SEQ ID NO: 39548 - DNA, 21 bp, Artificial Sequence
  Synthetic Construct
tgtgaggaaggcgggaggaaa

SEQ ID NO: 39549 - DNA, 25 bp, Artificial Sequence
  Synthetic Construct
cccatacaactccgagccctagttt

SEQ ID NO: 39550 - DNA, 21 bp, Artificial Sequence
  Synthetic Construct
gcctccaaaggcaaagactga

SEQ ID NO: 39551 - DNA, 25 bp, Artificial Sequence
  Synthetic Construct
gaagtcttgcaaaaagggtcttcat

SEQ ID NO: 39552 - DNA, 20 bp, Artificial Sequence
  Synthetic Construct
cacctttgcaccgaggctta

SEQ ID NO: 39553 - DNA, 22 bp, Artificial Sequence
  Synthetic Construct
gctgcctgaaagcctggatctt

SEQ ID NO: 39554 - DNA, 20 bp, Artificial Sequence
  Synthetic Construct
gcacaccgtgcaggttgata

SEQ ID NO: 39555 - DNA, 20 bp, Artificial Sequence
  Synthetic Construct
cagcaaccagccagaagtgt

SEQ ID NO: 39556 - DNA, 22 bp, Artificial Sequence
  Synthetic Construct
gcctgagagtcggcatttggtt

SEQ ID NO: 39557 - DNA, 24 bp, Artificial Sequence
  Synthetic Construct
tttgccatctttgcagaacctatg

SEQ ID NO: 39558 - DNA, 24 bp, Artificial Sequence
  Synthetic Construct
ggcaaaaggtgaaaggatcagaga

SEQ ID NO: 39559 - DNA, 24 bp, Artificial Sequence
  Synthetic Construct
gctgggaccgaaactgagttatgt

SEQ ID NO: 39560 - DNA, 21 bp, Artificial Sequence
  Synthetic Construct
tgtgaaaggagggcacctgta

SEQ ID NO: 39561 - DNA, 20 bp, Artificial Sequence
  Synthetic Construct
ggctgggagtggcaaaaaca

SEQ ID NO: 39562 - DNA, 23 bp, Artificial Sequence
  Synthetic Construct
ccagagggtctgagttctactgt

SEQ ID NO: 39563 - DNA, 23 bp, Artificial Sequence
  Synthetic Construct
gagccttcaagttgttgggttga

SEQ ID NO: 39564 - DNA, 23 bp, Artificial Sequence
  Synthetic Construct
gaaagttttggtgtggcttggtt

SEQ ID NO: 39565 - DNA, 22 bp, Artificial Sequence
  Synthetic Construct
cgagccaaccatgggctaagaa

SEQ ID NO: 39566 - DNA, 22 bp, Artificial Sequence
  Synthetic Construct
ggcagtgaaaactgctgctgta

SEQ ID NO: 39567 - DNA, 21 bp, Artificial Sequence
  Synthetic Construct
ggggtccccagcaatctaact

SEQ ID NO: 39568 - DNA, 23 bp, Artificial Sequence
  Synthetic Construct
cctctctgtgtgagccgtgtaag

SEQ ID NO: 39569 - DNA, 22 bp, Artificial Sequence
  Synthetic Construct
gacagaccttgtggggcttaac

SEQ ID NO: 39570 - DNA, 22 bp, Artificial Sequence
  Synthetic Construct
aggaatggactggaaccagaga

SEQ ID NO: 39571 - DNA, 22 bp, Artificial Sequence
  Synthetic Construct
ggcatggtttcatctggtcagt

SEQ ID NO: 39572 - DNA, 22 bp, Artificial Sequence
  Synthetic Construct
ggccaaggactggtatgtgtct

SEQ ID NO: 39573 - DNA, 21 bp, Artificial Sequence
  Synthetic Construct
ccatgcttcctcctgccacta

SEQ ID NO: 39574 - DNA, 22 bp, Artificial Sequence
  Synthetic Construct
gggtctcggctgacaagatgta

SEQ ID NO: 39575 - DNA, 24 bp, Artificial Sequence
  Synthetic Construct
ggagagtacagcaagggagtctga

SEQ ID NO: 39576 - DNA, 20 bp, Artificial Sequence
  Synthetic Construct
tacccctgctccctctggtt

SEQ ID NO: 39577 - DNA, 22 bp, Artificial Sequence
  Synthetic Construct
gtagtttgagaccagcctgctt

SEQ ID NO: 39578 - DNA, 23 bp, Artificial Sequence
  Synthetic Construct
tgactctggcctattctccaaca

SEQ ID NO: 39579 - DNA, 24 bp, Artificial Sequence
  Synthetic Construct
ccaagatttcccaccagctacaca

SEQ ID NO: 39580 - DNA, 24 bp, Artificial Sequence
  Synthetic Construct
ggtggttttctctcagcagctctt

SEQ ID NO: 39581 - DNA, 23 bp, Artificial Sequence
  Synthetic Construct
caccaacgacagagcagaaaatc

SEQ ID NO: 39582 - DNA, 24 bp, Artificial Sequence
  Synthetic Construct
cagcatcctccaaggtttcagcta

SEQ ID NO: 39583 - DNA, 23 bp, Artificial Sequence
  Synthetic Construct
gctcctatgggaaacagggaatg

SEQ ID NO: 39584 - DNA, 24 bp, Artificial Sequence
  Synthetic Construct
ccaaccagaagctaaatggcaagt

SEQ ID NO: 39585 - DNA, 22 bp, Artificial Sequence
  Synthetic Construct
cccaaacacactggggaagagt

SEQ ID NO: 39586 - DNA, 27 bp, Artificial Sequence
  Synthetic Construct
gggattaagatgggtgaagctgggaat

SEQ ID NO: 39587 - DNA, 20 bp, Artificial Sequence
  Synthetic Construct
accactgagtcccgtcttgt

SEQ ID NO: 39588 - DNA, 25 bp, Artificial Sequence
  Synthetic Construct
ccagatttaccaacatggagagaca

SEQ ID NO: 39589 - DNA, 20 bp, Artificial Sequence
  Synthetic Construct
atccctgccaccagttgtgt

SEQ ID NO: 39590 - DNA, 25 bp, Artificial Sequence
  Synthetic Construct
gttcctcaaggggaacttgaactac

SEQ ID NO: 39591 - DNA, 25 bp, Artificial Sequence
  Synthetic Construct
ggaaggtcacaagacatcagccata

SEQ ID NO: 39592 - DNA, 26 bp, Artificial Sequence
  Synthetic Construct
gtcctccaaatctgtccacttcatct

SEQ ID NO: 39593 - DNA, 23 bp, Artificial Sequence
  Synthetic Construct
gcagaccaggatgggaccagata

SEQ ID NO: 39594 - DNA, 24 bp, Artificial Sequence
  Synthetic Construct
gattatgctgaaaactgcccttgt

SEQ ID NO: 39595 - DNA, 21 bp, Artificial Sequence
  Synthetic Construct
accagtgtgtccctggactgt

SEQ ID NO: 39596 - DNA, 25 bp, Artificial Sequence
  Synthetic Construct
caacaatgggctaacctttctcttc

SEQ ID NO: 39597 - DNA, 21 bp, Artificial Sequence
  Synthetic Construct
tggctcctctgctccttcctt

SEQ ID NO: 39598 - DNA, 21 bp, Artificial Sequence
  Synthetic Construct
tggggtttaggggaggagtga

SEQ ID NO: 39599 - DNA, 27 bp, Artificial Sequence
  Synthetic Construct
gcatatacggtaaaccttagtccaaac

SEQ ID NO: 39600 - DNA, 22 bp, Artificial Sequence
  Synthetic Construct
cacacaggctttcccctcaatc

SEQ ID NO: 39601 - DNA, 22 bp, Artificial Sequence
  Synthetic Construct
gctgcttcttcccctgaaccaa

SEQ ID NO: 39602 - DNA, 27 bp, Artificial Sequence
  Synthetic Construct
cagtgttttcaataccacccaatgaag

SEQ ID NO: 39603 - DNA, 22 bp, Artificial Sequence
  Synthetic Construct
gtggctttgttctgacgtgctt

SEQ ID NO: 39604 - DNA, 28 bp, Artificial Sequence
  Synthetic Construct
gagcattagtgttagagggtatcacaca

SEQ ID NO: 39605 - DNA, 22 bp, Artificial Sequence
  Synthetic Construct
gtgtaggagtcggggaaagtga

SEQ ID NO: 39606 - DNA, 22 bp, Artificial Sequence
  Synthetic Construct
cccaggtaggttaggctccaat

SEQ ID NO: 39607 - DNA, 25 bp, Artificial Sequence
  Synthetic Construct
gccaaatcctctggaatatggtgaa

SEQ ID NO: 39608 - DNA, 24 bp, Artificial Sequence
  Synthetic Construct
cgtgcaagaactagctgtttgtct

SEQ ID NO: 39609 - DNA, 24 bp, Artificial Sequence
  Synthetic Construct
gggagacagcatgtatcgtagttc

SEQ ID NO: 39610 - DNA, 21 bp, Artificial Sequence
  Synthetic Construct
tcccacctgcctttttcaact

SEQ ID NO: 39611 - DNA, 27 bp, Artificial Sequence
  Synthetic Construct
ctggcactgtttacctcttctagatac

SEQ ID NO: 39612 - DNA, 20 bp, Artificial Sequence
  Synthetic Construct
cccaggcaaagtgggtgtct

SEQ ID NO: 39613 - DNA, 20 bp, Artificial Sequence
  Synthetic Construct
ggccagcaaggggtgaagat

SEQ ID NO: 39614 - DNA, 25 bp, Artificial Sequence
  Synthetic Construct
tgaatccaaatcttggggtgagaag

SEQ ID NO: 39615 - DNA, 25 bp, Artificial Sequence
  Synthetic Construct
ctccatgtgtttgctctcaatcttc

SEQ ID NO: 39616 - DNA, 20 bp, Artificial Sequence
  Synthetic Construct
tctacccgtccaaccccaaa

SEQ ID NO: 39617 - DNA, 30 bp, Artificial Sequence
  Synthetic Construct
cctcatttatcaactgcattctgtctcaag

SEQ ID NO: 39618 - DNA, 26 bp, Artificial Sequence
  Synthetic Construct
cctacttctctcccttagtgggtact

SEQ ID NO: 39619 - DNA, 21 bp, Artificial Sequence
  Synthetic Construct
caggtgtgagccactgtttct

SEQ ID NO: 39620 - DNA, 23 bp, Artificial Sequence
  Synthetic Construct
ccccacatgtgagtcagtagttc

SEQ ID NO: 39621 - DNA, 22 bp, Artificial Sequence
  Synthetic Construct
tgcataaggccactttgagtga

SEQ ID NO: 39622 - DNA, 25 bp, Artificial Sequence
  Synthetic Construct
gcccagttttctcataccacctaag

SEQ ID NO: 39623 - DNA, 24 bp, Artificial Sequence
  Synthetic Construct
gctgtccagctttccacattctgt

SEQ ID NO: 39624 - DNA, 22 bp, Artificial Sequence
  Synthetic Construct
ggcctgagtggatgcaaagcta

SEQ ID NO: 39625 - DNA, 20 bp, Artificial Sequence
  Synthetic Construct
ttccctagcaccgtgagtct

SEQ ID NO: 39626 - DNA, 20 bp, Artificial Sequence
  Synthetic Construct
gccttggcctgtgatgaaca

SEQ ID NO: 39627 - DNA, 23 bp, Artificial Sequence
  Synthetic Construct
ggttctgggcatagagacttcaa

SEQ ID NO: 39628 - DNA, 24 bp, Artificial Sequence
  Synthetic Construct
cccaggaaccaaggttttgcaact

SEQ ID NO: 39629 - DNA, 21 bp, Artificial Sequence
  Synthetic Construct
gccctccctcaactccaatca

SEQ ID NO: 39630 - DNA, 21 bp, Artificial Sequence
  Synthetic Construct
ccagagctgccactgtaatca

SEQ ID NO: 39631 - DNA, 25 bp, Artificial Sequence
  Synthetic Construct
gtgaggtttgcttcttaagcacatt

SEQ ID NO: 39632 - DNA, 27 bp, Artificial Sequence
  Synthetic Construct
ctggctcagtaggtaaaagaagggatt

SEQ ID NO: 39633 - DNA, 23 bp, Artificial Sequence
  Synthetic Construct
acacagaagcttttgcagtgttg

SEQ ID NO: 39634 - DNA, 22 bp, Artificial Sequence
  Synthetic Construct
gctctgtgtcctgggagttgat

SEQ ID NO: 39635 - DNA, 20 bp, Artificial Sequence
  Synthetic Construct
agcaagaaccccaggcagtt

SEQ ID NO: 39636 - DNA, 21 bp, Artificial Sequence
  Synthetic Construct
gatgtctgctgttgggcaatg

SEQ ID NO: 39637 - DNA, 19 bp, Artificial Sequence
  Synthetic Construct
ggtgtgcgctaccacaact

SEQ ID NO: 39638 - DNA, 23 bp, Artificial Sequence
  Synthetic Construct
gtgggtctctttgggagcataag

SEQ ID NO: 39639 - DNA, 22 bp, Artificial Sequence
  Synthetic Construct
ggcagctcaatgggtgtgattc

SEQ ID NO: 39640 - DNA, 23 bp, Artificial Sequence
  Synthetic Construct
gggcaggttacaaggagtgtctt

SEQ ID NO: 39641 - DNA, 20 bp, Artificial Sequence
  Synthetic Construct
tgcccaccagtaagcagaga

SEQ ID NO: 39642 - DNA, 21 bp, Artificial Sequence
  Synthetic Construct
gggttgcctctcttccctgat

SEQ ID NO: 39643 - DNA, 22 bp, Artificial Sequence
  Synthetic Construct
tccaggaccagcatcagacact

SEQ ID NO: 39644 - DNA, 20 bp, Artificial Sequence
  Synthetic Construct
tgtgctgtcccttcctccat

SEQ ID NO: 39645 - DNA, 29 bp, Artificial Sequence
  Synthetic Construct
ggatgaactgagttgaaaggagtttgtgt

SEQ ID NO: 39646 - DNA, 21 bp, Artificial Sequence
  Synthetic Construct
gggagagctgtgtggatgctt

SEQ ID NO: 39647 - DNA, 22 bp, Artificial Sequence
  Synthetic Construct
tctcccatttgccacagagttc

SEQ ID NO: 39648 - DNA, 22 bp, Artificial Sequence
  Synthetic Construct
ccacaggaactgcatgatcgta

SEQ ID NO: 39649 - DNA, 24 bp, Artificial Sequence
  Synthetic Construct
cagctggttgctcagaatccaaac

SEQ ID NO: 39650 - DNA, 22 bp, Artificial Sequence
  Synthetic Construct
gtctgctgactgactgcctaac

SEQ ID NO: 39651 - DNA, 22 bp, Artificial Sequence
  Synthetic Construct
aatggagacggggctgacttac

SEQ ID NO: 39652 - DNA, 22 bp, Artificial Sequence
  Synthetic Construct
ctttccaggagccagggactaa

SEQ ID NO: 39653 - DNA, 20 bp, Artificial Sequence
  Synthetic Construct
agtaacggggagccaggatt

SEQ ID NO: 39654 - DNA, 21 bp, Artificial Sequence
  Synthetic Construct
ccaagtcgctgcaaacgctaa

SEQ ID NO: 39655 - DNA, 21 bp, Artificial Sequence
  Synthetic Construct
gtgaaaagcacccaggcaact

SEQ ID NO: 39656 - DNA, 24 bp, Artificial Sequence
  Synthetic Construct
ctgggtggttccaacattttgatg

SEQ ID NO: 39657 - DNA, 21 bp, Artificial Sequence
  Synthetic Construct
cttgccaaacgaggtgctaag

SEQ ID NO: 39658 - DNA, 24 bp, Artificial Sequence
  Synthetic Construct
catgatcccatcccagaattgaga

SEQ ID NO: 39659 - DNA, 21 bp, Artificial Sequence
  Synthetic Construct
cctgttttggcccatgcctat

SEQ ID NO: 39660 - DNA, 19 bp, Artificial Sequence
  Synthetic Construct
ccagcccacaaaccacaca

SEQ ID NO: 39661 - DNA, 23 bp, Artificial Sequence
  Synthetic Construct
gctgagtagaaacccagtgaaca

SEQ ID NO: 39662 - DNA, 23 bp, Artificial Sequence
  Synthetic Construct
accttcatcgagttccatggttt

SEQ ID NO: 39663 - DNA, 24 bp, Artificial Sequence
  Synthetic Construct
ctgcaaacagttgcctttgtggtt

SEQ ID NO: 39664 - DNA, 20 bp, Artificial Sequence
  Synthetic Construct
agcagccaccgattcctttg

SEQ ID NO: 39665 - DNA, 22 bp, Artificial Sequence
  Synthetic Construct
gtcggacagagttgcctgtttg

SEQ ID NO: 39666 - DNA, 22 bp, Artificial Sequence
  Synthetic Construct
cctcaccaggaaagtgccatta

SEQ ID NO: 39667 - DNA, 24 bp, Artificial Sequence
  Synthetic Construct
ggaactctgcaggtgaacagacaa

SEQ ID NO: 39668 - DNA, 19 bp, Artificial Sequence
  Synthetic Construct
gcatggggaggagctgaca

SEQ ID NO: 39669 - DNA, 24 bp, Artificial Sequence
  Synthetic Construct
gtgtatggtaaacgcttcctcctt

SEQ ID NO: 39670 - DNA, 25 bp, Artificial Sequence
  Synthetic Construct
ggaagacctacaccactgtcacctt

SEQ ID NO: 39671 - DNA, 21 bp, Artificial Sequence
  Synthetic Construct
ggtcagaaaggcagagcactt

SEQ ID NO: 39672 - DNA, 22 bp, Artificial Sequence
  Synthetic Construct
agataatccctggggcctcttc

SEQ ID NO: 39673 - DNA, 26 bp, Artificial Sequence
  Synthetic Construct
atctaccaagtgtactggatggattc

SEQ ID NO: 39674 - DNA, 23 bp, Artificial Sequence
  Synthetic Construct
ggacaaagatgggcagctcaaac

SEQ ID NO: 39675 - DNA, 23 bp, Artificial Sequence
  Synthetic Construct
gtctctctgcctcactcctaaca

SEQ ID NO: 39676 - DNA, 22 bp, Artificial Sequence
  Synthetic Construct
cctagtggtccaagcccaatca

SEQ ID NO: 39677 - DNA, 27 bp, Artificial Sequence
  Synthetic Construct
gctgtttttagatgggaacggaagcat

SEQ ID NO: 39678 - DNA, 20 bp, Artificial Sequence
  Synthetic Construct
accacgatcaggctctgctt

SEQ ID NO: 39679 - DNA, 21 bp, Artificial Sequence
  Synthetic Construct
aggcaagcactggattcaaca

SEQ ID NO: 39680 - DNA, 23 bp, Artificial Sequence
  Synthetic Construct
ccctcctgggctctgaaactaac

SEQ ID NO: 39681 - DNA, 21 bp, Artificial Sequence
  Synthetic Construct
aacctggggtgtggacagaga

SEQ ID NO: 39682 - DNA, 23 bp, Artificial Sequence
  Synthetic Construct
caccagagtgcattgtcagatgt

SEQ ID NO: 39683 - DNA, 23 bp, Artificial Sequence
  Synthetic Construct
tggttaggaaccaaagccttcat

SEQ ID NO: 39684 - DNA, 22 bp, Artificial Sequence
  Synthetic Construct
cacatgtgtgcttaggggtagt

SEQ ID NO: 39685 - DNA, 22 bp, Artificial Sequence
  Synthetic Construct
gcccctccagacttttggaact

SEQ ID NO: 39686 - DNA, 27 bp, Artificial Sequence
  Synthetic Construct
ggttacatttcctcctccatttacagt

SEQ ID NO: 39687 - DNA, 23 bp, Artificial Sequence
  Synthetic Construct
cttgcattccaggaaacccaatg

SEQ ID NO: 39688 - DNA, 23 bp, Artificial Sequence
  Synthetic Construct
ggaagcctcgccacaagaataag

SEQ ID NO: 39689 - DNA, 20 bp, Artificial Sequence
  Synthetic Construct
aggctccccaccttggattt

SEQ ID NO: 39690 - DNA, 25 bp, Artificial Sequence
  Synthetic Construct
ggcccagaacattgggagtggaata

SEQ ID NO: 39691 - DNA, 24 bp, Artificial Sequence
  Synthetic Construct
ggaagcaacactgatactgagaga

SEQ ID NO: 39692 - DNA, 21 bp, Artificial Sequence
  Synthetic Construct
gcagctgcgaataaagctgaa

SEQ ID NO: 39693 - DNA, 19 bp, Artificial Sequence
  Synthetic Construct
ttgctggagtgctgcttca

SEQ ID NO: 39694 - DNA, 20 bp, Artificial Sequence
  Synthetic Construct
agtcacagcccactggaaac

SEQ ID NO: 39695 - DNA, 22 bp, Artificial Sequence
  Synthetic Construct
cagagctgtttctgccatggat

SEQ ID NO: 39696 - DNA, 23 bp, Artificial Sequence
  Synthetic Construct
tgcaagttcacgtgtcttcatgt

SEQ ID NO: 39697 - DNA, 22 bp, Artificial Sequence
  Synthetic Construct
ggttcccggagttcctgtttgt

SEQ ID NO: 39698 - DNA, 18 bp, Artificial Sequence
  Synthetic Construct
tccctcaccagcctgcat

SEQ ID NO: 39699 - DNA, 23 bp, Artificial Sequence
  Synthetic Construct
tcacaccttctgaaacccacatt

SEQ ID NO: 39700 - DNA, 30 bp, Artificial Sequence
  Synthetic Construct
cgaggacttagaactgtagcttaaaagtag

SEQ ID NO: 39701 - DNA, 24 bp, Artificial Sequence
  Synthetic Construct
ggacactacagagatagccctctt

SEQ ID NO: 39702 - DNA, 24 bp, Artificial Sequence
  Synthetic Construct
tgacttgtcttctgcaaagctcta

SEQ ID NO: 39703 - DNA, 24 bp, Artificial Sequence
  Synthetic Construct
gagagtggcactgcaatatcatca

SEQ ID NO: 39704 - DNA, 18 bp, Artificial Sequence
  Synthetic Construct
agggccttgcacgcacat

SEQ ID NO: 39705 - DNA, 23 bp, Artificial Sequence
  Synthetic Construct
ctggagaaggaagccgatgttag

SEQ ID NO: 39706 - DNA, 23 bp, Artificial Sequence
  Synthetic Construct
ggtgtcttgccttgtttgggtaa

SEQ ID NO: 39707 - DNA, 25 bp, Artificial Sequence
  Synthetic Construct
ccttgaaccttgtcatgcctaaaac

SEQ ID NO: 39708 - DNA, 22 bp, Artificial Sequence
  Synthetic Construct
tgtaccacacgtcaagcacttt

SEQ ID NO: 39709 - DNA, 20 bp, Artificial Sequence
  Synthetic Construct
tcaaagctgcctgggagatg

SEQ ID NO: 39710 - DNA, 20 bp, Artificial Sequence
  Synthetic Construct
ggaaccgggctggatgaaga

SEQ ID NO: 39711 - DNA, 24 bp, Artificial Sequence
  Synthetic Construct
cctgcatcaccaagtccattctca

SEQ ID NO: 39712 - DNA, 23 bp, Artificial Sequence
  Synthetic Construct
tcatggttgccaaagaacctact

SEQ ID NO: 39713 - DNA, 20 bp, Artificial Sequence
  Synthetic Construct
caccatggctatggcacaga

SEQ ID NO: 39714 - DNA, 30 bp, Artificial Sequence
  Synthetic Construct
cacaattatccctattatcgcccacaaaga

SEQ ID NO: 39715 - DNA, 24 bp, Artificial Sequence
  Synthetic Construct
gctggttcacttctctcccaggta

SEQ ID NO: 39716 - DNA, 24 bp, Artificial Sequence
  Synthetic Construct
gaagaggctcatttcccttgtttg

SEQ ID NO: 39717 - DNA, 23 bp, Artificial Sequence
  Synthetic Construct
gagtctggggtgacagagtctta

SEQ ID NO: 39718 - DNA, 28 bp, Artificial Sequence
  Synthetic Construct
cctccagtgaatttaccttgccagtttc

SEQ ID NO: 39719 - DNA, 23 bp, Artificial Sequence
  Synthetic Construct
gatggctggtggagtaatcaagt

SEQ ID NO: 39720 - DNA, 22 bp, Artificial Sequence
  Synthetic Construct
ttctggctacacgcccctttac

SEQ ID NO: 39721 - DNA, 20 bp, Artificial Sequence
  Synthetic Construct
tgctgtccatggccacattc

SEQ ID NO: 39722 - DNA, 27 bp, Artificial Sequence
  Synthetic Construct
catcagaaaataggtttggggtaggtt

SEQ ID NO: 39723 - DNA, 20 bp, Artificial Sequence
  Synthetic Construct
aggacctgaggcccagaagt

SEQ ID NO: 39724 - DNA, 25 bp, Artificial Sequence
  Synthetic Construct
gctaaacacaaacttccctccaagt

SEQ ID NO: 39725 - DNA, 20 bp, Artificial Sequence
  Synthetic Construct
tcagttgcctggctggtttg

SEQ ID NO: 39726 - DNA, 22 bp, Artificial Sequence
  Synthetic Construct
aatcaggagctgttggtgttgt

SEQ ID NO: 39727 - DNA, 20 bp, Artificial Sequence
  Synthetic Construct
ccacctggaagccaagttga

SEQ ID NO: 39728 - DNA, 22 bp, Artificial Sequence
  Synthetic Construct
tccaaaccctccctgtcctaag

SEQ ID NO: 39729 - DNA, 23 bp, Artificial Sequence
  Synthetic Construct
tggacatggcaaattggatggat

SEQ ID NO: 39730 - DNA, 25 bp, Artificial Sequence
  Synthetic Construct
gcctgtcttttctgtgcaaggttag

SEQ ID NO: 39731 - DNA, 22 bp, Artificial Sequence
  Synthetic Construct
gtcaggagaggccatcagcttt

SEQ ID NO: 39732 - DNA, 20 bp, Artificial Sequence
  Synthetic Construct
tcccacagtgccctggcata

SEQ ID NO: 39733 - DNA, 23 bp, Artificial Sequence
  Synthetic Construct
cttggatcaactttcccgacaac

SEQ ID NO: 39734 - DNA, 23 bp, Artificial Sequence
  Synthetic Construct
tggaccgtaatgacaccagtaac

SEQ ID NO: 39735 - DNA, 21 bp, Artificial Sequence
  Synthetic Construct
ccaccagtcctggacactgat

SEQ ID NO: 39736 - DNA, 27 bp, Artificial Sequence
  Synthetic Construct
ggtgagcttaaattaggaggaggatag

SEQ ID NO: 39737 - DNA, 20 bp, Artificial Sequence
  Synthetic Construct
gttgaccttcaggccacaga

SEQ ID NO: 39738 - DNA, 21 bp, Artificial Sequence
  Synthetic Construct
accctgtgatggggtgctgtt

SEQ ID NO: 39739 - DNA, 20 bp, Artificial Sequence
  Synthetic Construct
agccaaggacaagcgacact

SEQ ID NO: 39740 - DNA, 23 bp, Artificial Sequence
  Synthetic Construct
cctgaatggcattgggcttgact

SEQ ID NO: 39741 - DNA, 23 bp, Artificial Sequence
  Synthetic Construct
gggttcagcattcatggggtaag

SEQ ID NO: 39742 - DNA, 23 bp, Artificial Sequence
  Synthetic Construct
caagctgggatagagggcttttg

SEQ ID NO: 39743 - DNA, 21 bp, Artificial Sequence
  Synthetic Construct
gcaggtgctcttcctgctgtt

SEQ ID NO: 39744 - DNA, 25 bp, Artificial Sequence
  Synthetic Construct
gaatgggcaaagcactggtaatttt

SEQ ID NO: 39745 - DNA, 22 bp, Artificial Sequence
  Synthetic Construct
gcttgagggtctgccaatccat

SEQ ID NO: 39746 - DNA, 24 bp, Artificial Sequence
  Synthetic Construct
gggccttacttggggagaagaagt

SEQ ID NO: 39747 - DNA, 20 bp, Artificial Sequence
  Synthetic Construct
aggtggcagaggatgcattg

SEQ ID NO: 39748 - DNA, 19 bp, Artificial Sequence
  Synthetic Construct
ttctgcctcaccccagctt

SEQ ID NO: 39749 - DNA, 22 bp, Artificial Sequence
  Synthetic Construct
tccccttcactcgaggtactgt

SEQ ID NO: 39750 - DNA, 22 bp, Artificial Sequence
  Synthetic Construct
ccaaccatgcagtgatgctgta

SEQ ID NO: 39751 - DNA, 25 bp, Artificial Sequence
  Synthetic Construct
cccctgcaactatcatccctgtaag

SEQ ID NO: 39752 - DNA, 24 bp, Artificial Sequence
  Synthetic Construct
gcctgcttggagtctctcacaaat

SEQ ID NO: 39753 - DNA, 19 bp, Artificial Sequence
  Synthetic Construct
acgagccaccatgccctta

SEQ ID NO: 39754 - DNA, 24 bp, Artificial Sequence
  Synthetic Construct
ctccatcctgtctggcctaaaatg

SEQ ID NO: 39755 - DNA, 26 bp, Artificial Sequence
  Synthetic Construct
cttctcttcactcaacagaggaacaa

SEQ ID NO: 39756 - DNA, 21 bp, Artificial Sequence
  Synthetic Construct
gtggttggaccgttagcatgt

SEQ ID NO: 39757 - DNA, 22 bp, Artificial Sequence
  Synthetic Construct
gggaaggcttctggagttgatg

SEQ ID NO: 39758 - DNA, 22 bp, Artificial Sequence
  Synthetic Construct
tggagccccatccagatcttag

SEQ ID NO: 39759 - DNA, 21 bp, Artificial Sequence
  Synthetic Construct
gctttgccaggcacatctcaa

SEQ ID NO: 39760 - DNA, 19 bp, Artificial Sequence
  Synthetic Construct
agatggggagggccatcaa

SEQ ID NO: 39761 - DNA, 21 bp, Artificial Sequence
  Synthetic Construct
caggcttggcattgtgacttg

SEQ ID NO: 39762 - DNA, 22 bp, Artificial Sequence
  Synthetic Construct
gccaagtaactcaggcccttgt

SEQ ID NO: 39763 - DNA, 19 bp, Artificial Sequence
  Synthetic Construct
ccttgggagccaggcacat

SEQ ID NO: 39764 - DNA, 21 bp, Artificial Sequence
  Synthetic Construct
taccccactgtgcccctttca

SEQ ID NO: 39765 - DNA, 23 bp, Artificial Sequence
  Synthetic Construct
ggaatcatggcttggcagtttca

SEQ ID NO: 39766 - DNA, 23 bp, Artificial Sequence
  Synthetic Construct
gcccaggcagatctacaggtact

SEQ ID NO: 39767 - DNA, 22 bp, Artificial Sequence
  Synthetic Construct
gcttggttccatggggagtgaa

SEQ ID NO: 39768 - DNA, 22 bp, Artificial Sequence
  Synthetic Construct
ctcagagtctggttccctgaga

SEQ ID NO: 39769 - DNA, 23 bp, Artificial Sequence
  Synthetic Construct
cagacaaggaaacagccctggat

SEQ ID NO: 39770 - DNA, 23 bp, Artificial Sequence
  Synthetic Construct
ccctccctggctagaagttcctt

SEQ ID NO: 39771 - DNA, 27 bp, Artificial Sequence
  Synthetic Construct
gctgttttcaaggctaaaggtaacgat

SEQ ID NO: 39772 - DNA, 21 bp, Artificial Sequence
  Synthetic Construct
cacctgtaccttgggttgctt

SEQ ID NO: 39773 - DNA, 24 bp, Artificial Sequence
  Synthetic Construct
ccagatctagaaccctggtagcat

SEQ ID NO: 39774 - DNA, 20 bp, Artificial Sequence
  Synthetic Construct
actccacaggtgccatccta

SEQ ID NO: 39775 - DNA, 24 bp, Artificial Sequence
  Synthetic Construct
ccttccaaccactttctgccttgt

SEQ ID NO: 39776 - DNA, 25 bp, Artificial Sequence
  Synthetic Construct
ggcaaaagcaaatagggctggacta

SEQ ID NO: 39777 - DNA, 22 bp, Artificial Sequence
  Synthetic Construct
tcctcttcctgcagctgataca

SEQ ID NO: 39778 - DNA, 25 bp, Artificial Sequence
  Synthetic Construct
ggtcattctgcctgtcttagggaat

SEQ ID NO: 39779 - DNA, 20 bp, Artificial Sequence
  Synthetic Construct
tttgggtgggccacggttta

SEQ ID NO: 39780 - DNA, 22 bp, Artificial Sequence
  Synthetic Construct
ctgaagagcctcccaacacaca

SEQ ID NO: 39781 - DNA, 24 bp, Artificial Sequence
  Synthetic Construct
ccgacttgctcatcatgggtgatt

SEQ ID NO: 39782 - DNA, 20 bp, Artificial Sequence
  Synthetic Construct
acacggccaagcacagtcaa

SEQ ID NO: 39783 - DNA, 22 bp, Artificial Sequence
  Synthetic Construct
cccagcagccatttccactgat

SEQ ID NO: 39784 - DNA, 20 bp, Artificial Sequence
  Synthetic Construct
gccaggcaaaccttgtcatc

SEQ ID NO: 39785 - DNA, 25 bp, Artificial Sequence
  Synthetic Construct
gggacattctctggttattgacgaa

SEQ ID NO: 39786 - DNA, 22 bp, Artificial Sequence
  Synthetic Construct
cctagctcctgtgagacacaac

SEQ ID NO: 39787 - DNA, 22 bp, Artificial Sequence
  Synthetic Construct
ggcttcagaggcagtgacagaa

SEQ ID NO: 39788 - DNA, 20 bp, Artificial Sequence
  Synthetic Construct
agtgtgacgagggtgaggaa

SEQ ID NO: 39789 - DNA, 19 bp, Artificial Sequence
  Synthetic Construct
gagggcagaccagggatga

SEQ ID NO: 39790 - DNA, 23 bp, Artificial Sequence
  Synthetic Construct
atttgcatcacctcccttagctt

SEQ ID NO: 39791 - DNA, 25 bp, Artificial Sequence
  Synthetic Construct
cggataaaggctacgaacacaagaa

SEQ ID NO: 39792 - DNA, 25 bp, Artificial Sequence
  Synthetic Construct
ggatactctgacctgctgttagttt

SEQ ID NO: 39793 - DNA, 22 bp, Artificial Sequence
  Synthetic Construct
gctaagtgcgagggctttggaa

SEQ ID NO: 39794 - DNA, 24 bp, Artificial Sequence
  Synthetic Construct
cagcaaaaccaaagtgctgtgcta

SEQ ID NO: 39795 - DNA, 20 bp, Artificial Sequence
  Synthetic Construct
aggcctgagtgccgatctaa

SEQ ID NO: 39796 - DNA, 24 bp, Artificial Sequence
  Synthetic Construct
ctccctcttggctactctttggat

SEQ ID NO: 39797 - DNA, 22 bp, Artificial Sequence
  Synthetic Construct
caccctcttaccagcagcaaca

SEQ ID NO: 39798 - DNA, 25 bp, Artificial Sequence
  Synthetic Construct
actacatccttcagtggcaacatac

SEQ ID NO: 39799 - DNA, 22 bp, Artificial Sequence
  Synthetic Construct
cagagaacaggctcagctgtca

SEQ ID NO: 39800 - DNA, 23 bp, Artificial Sequence
  Synthetic Construct
gatggagagagtgattggcaaga

SEQ ID NO: 39801 - DNA, 26 bp, Artificial Sequence
  Synthetic Construct
gactgattctgccacctatactgaac

SEQ ID NO: 39802 - DNA, 29 bp, Artificial Sequence
  Synthetic Construct
cctggacctttcttaataccaggaacctt

SEQ ID NO: 39803 - DNA, 26 bp, Artificial Sequence
  Synthetic Construct
ctcattgtccacagattgatcaccat

SEQ ID NO: 39804 - DNA, 26 bp, Artificial Sequence
  Synthetic Construct
gaaaggagagataggttagcgttttg

SEQ ID NO: 39805 - DNA, 23 bp, Artificial Sequence
  Synthetic Construct
gggtgtcattttccttgcttgaa

SEQ ID NO: 39806 - DNA, 25 bp, Artificial Sequence
  Synthetic Construct
cagggtaacaggccagagttaatca

SEQ ID NO: 39807 - DNA, 20 bp, Artificial Sequence
  Synthetic Construct
agaacccatgggctggaaga

SEQ ID NO: 39808 - DNA, 22 bp, Artificial Sequence
  Synthetic Construct
gctgtgagcaaggttcctgtgt

SEQ ID NO: 39809 - DNA, 25 bp, Artificial Sequence
  Synthetic Construct
ctgcagtattcacagagcctcaagt

SEQ ID NO: 39810 - DNA, 23 bp, Artificial Sequence
  Synthetic Construct
agaactgtgcctgctagtacatc

SEQ ID NO: 39811 - DNA, 20 bp, Artificial Sequence
  Synthetic Construct
ttcccaaggtgccactgact

SEQ ID NO: 39812 - DNA, 22 bp, Artificial Sequence
  Synthetic Construct
caagggcttttggctcttcttc

SEQ ID NO: 39813 - DNA, 23 bp, Artificial Sequence
  Synthetic Construct
ctgtctcgaagatggtgccttgt

SEQ ID NO: 39814 - DNA, 22 bp, Artificial Sequence
  Synthetic Construct
cctcagtgtgctctctgcttgt

SEQ ID NO: 39815 - DNA, 23 bp, Artificial Sequence
  Synthetic Construct
cctcaaactaccccacaccaagt

SEQ ID NO: 39816 - DNA, 24 bp, Artificial Sequence
  Synthetic Construct
gagctggacttggataggtcagtt

SEQ ID NO: 39817 - DNA, 23 bp, Artificial Sequence
  Synthetic Construct
agctagtttgctcctacgtcttg

SEQ ID NO: 39818 - DNA, 18 bp, Artificial Sequence
  Synthetic Construct
gtggcttgggtgccagtt

SEQ ID NO: 39819 - DNA, 23 bp, Artificial Sequence
  Synthetic Construct
caagaggtgagaaggggtctagt

SEQ ID NO: 39820 - DNA, 25 bp, Artificial Sequence
  Synthetic Construct
agtccatgtatcaccaagctcattc

SEQ ID NO: 39821 - DNA, 19 bp, Artificial Sequence
  Synthetic Construct
acaaggtgggtggccaagt

SEQ ID NO: 39822 - DNA, 20 bp, Artificial Sequence
  Synthetic Construct
ggccttggaccctgaacaaa

SEQ ID NO: 39823 - DNA, 26 bp, Artificial Sequence
  Synthetic Construct
ccctcctaatgtctccctttcctttc

SEQ ID NO: 39824 - DNA, 26 bp, Artificial Sequence
  Synthetic Construct
ggtcactgactttgagatagcaagta

SEQ ID NO: 39825 - DNA, 22 bp, Artificial Sequence
  Synthetic Construct
ccagaagctccagtgtttgaca

SEQ ID NO: 39826 - DNA, 24 bp, Artificial Sequence
  Synthetic Construct
gctgctcctctattagctcctttt

SEQ ID NO: 39827 - DNA, 21 bp, Artificial Sequence
  Synthetic Construct
aaaagaggaagagcggcatga

SEQ ID NO: 39828 - DNA, 23 bp, Artificial Sequence
  Synthetic Construct
cagggatttgccacaaagcaatc

SEQ ID NO: 39829 - DNA, 21 bp, Artificial Sequence
  Synthetic Construct
ctgacatgtggctggcattct

SEQ ID NO: 39830 - DNA, 22 bp, Artificial Sequence
  Synthetic Construct
ggcacagcaatatgcaggtttt

SEQ ID NO: 39831 - DNA, 20 bp, Artificial Sequence
  Synthetic Construct
atcaggctgtgggtctctgt

SEQ ID NO: 39832 - DNA, 26 bp, Artificial Sequence
  Synthetic Construct
ccattttcattcgtgagtgggtcatt

SEQ ID NO: 39833 - DNA, 22 bp, Artificial Sequence
  Synthetic Construct
aactgggactgtcctgacaaag

SEQ ID NO: 39834 - DNA, 21 bp, Artificial Sequence
  Synthetic Construct
gccctgcaggagggaatcaat

SEQ ID NO: 39835 - DNA, 21 bp, Artificial Sequence
  Synthetic Construct
gccagaagcttgctcctcctt

SEQ ID NO: 39836 - DNA, 23 bp, Artificial Sequence
  Synthetic Construct
caacatgtatctctcgggcaaac

SEQ ID NO: 39837 - DNA, 22 bp, Artificial Sequence
  Synthetic Construct
gtaggtcacccacagtttgaca

SEQ ID NO: 39838 - DNA, 20 bp, Artificial Sequence
  Synthetic Construct
atgcccacagggagcctctt

SEQ ID NO: 39839 - DNA, 21 bp, Artificial Sequence
  Synthetic Construct
ttccatagagctggggagtgt

SEQ ID NO: 39840 - DNA, 21 bp, Artificial Sequence
  Synthetic Construct
agccaataaggagtgcgttca

SEQ ID NO: 39841 - DNA, 20 bp, Artificial Sequence
  Synthetic Construct
tgcggacagcagggctaaaa

SEQ ID NO: 39842 - DNA, 24 bp, Artificial Sequence
  Synthetic Construct
gcagttggaaccaaagactggtaa

SEQ ID NO: 39843 - DNA, 21 bp, Artificial Sequence
  Synthetic Construct
ctgtccgacttgggtgaaaca

SEQ ID NO: 39844 - DNA, 22 bp, Artificial Sequence
  Synthetic Construct
cacacaagctcacaggggtttg

SEQ ID NO: 39845 - DNA, 23 bp, Artificial Sequence
  Synthetic Construct
tctctgttcgtggagatcctagt

SEQ ID NO: 39846 - DNA, 22 bp, Artificial Sequence
  Synthetic Construct
ggatgctacccctggaggaaaa

SEQ ID NO: 39847 - DNA, 23 bp, Artificial Sequence
  Synthetic Construct
ggcttcaatcatgacaccagttg

SEQ ID NO: 39848 - DNA, 28 bp, Artificial Sequence
  Synthetic Construct
ctgatagaaaattgagctccaccacttc

SEQ ID NO: 39849 - DNA, 23 bp, Artificial Sequence
  Synthetic Construct
gccaggtatgtgaagaggtcagt

SEQ ID NO: 39850 - DNA, 20 bp, Artificial Sequence
  Synthetic Construct
tcccattccgccactcatct

SEQ ID NO: 39851 - DNA, 26 bp, Artificial Sequence
  Synthetic Construct
gtctcacttacagtggaaatgtcctt

SEQ ID NO: 39852 - DNA, 22 bp, Artificial Sequence
  Synthetic Construct
tccaaaggattcctgggctact

SEQ ID NO: 39853 - DNA, 20 bp, Artificial Sequence
  Synthetic Construct
actggaagccctgccactca

SEQ ID NO: 39854 - DNA, 19 bp, Artificial Sequence
  Synthetic Construct
cccagcaagcctgcactca

SEQ ID NO: 39855 - DNA, 22 bp, Artificial Sequence
  Synthetic Construct
cacccctacgtgttcaatcagt

SEQ ID NO: 39856 - DNA, 27 bp, Artificial Sequence
  Synthetic Construct
ggaaggtaaaggtggagagtgtctact

SEQ ID NO: 39857 - DNA, 23 bp, Artificial Sequence
  Synthetic Construct
gtggttgatgcctctttcctttc

SEQ ID NO: 39858 - DNA, 19 bp, Artificial Sequence
  Synthetic Construct
ggcctgtgcacccctttag

SEQ ID NO: 39859 - DNA, 24 bp, Artificial Sequence
  Synthetic Construct
cgtaataatgccctgatgctctct

SEQ ID NO: 39860 - DNA, 24 bp, Artificial Sequence
  Synthetic Construct
gtgggaaagaagggtgctgtattg

SEQ ID NO: 39861 - DNA, 25 bp, Artificial Sequence
  Synthetic Construct
gtttagtagcttggggttgaagaga

SEQ ID NO: 39862 - DNA, 24 bp, Artificial Sequence
  Synthetic Construct
gggaatttacagtccctcggcata

SEQ ID NO: 39863 - DNA, 20 bp, Artificial Sequence
  Synthetic Construct
accccagtgcctgcaaatgt

SEQ ID NO: 39864 - DNA, 23 bp, Artificial Sequence
  Synthetic Construct
gtcaaaacccaaaatgcgctcaa

SEQ ID NO: 39865 - DNA, 25 bp, Artificial Sequence
  Synthetic Construct
gatgcaatatgaagtgctgtcttga

SEQ ID NO: 39866 - DNA, 23 bp, Artificial Sequence
  Synthetic Construct
tgtggttatggccaatcctttct

SEQ ID NO: 39867 - DNA, 22 bp, Artificial Sequence
  Synthetic Construct
aattgtccgctttggagagcta

SEQ ID NO: 39868 - DNA, 20 bp, Artificial Sequence
  Synthetic Construct
tttgaggccctggcctgctt

SEQ ID NO: 39869 - DNA, 22 bp, Artificial Sequence
  Synthetic Construct
gcaggggaggaacatcaaggta

SEQ ID NO: 39870 - DNA, 23 bp, Artificial Sequence
  Synthetic Construct
gacacgacctctcttgacacttg

SEQ ID NO: 39871 - DNA, 21 bp, Artificial Sequence
  Synthetic Construct
acagatggggtgtaggagcaa

SEQ ID NO: 39872 - DNA, 21 bp, Artificial Sequence
  Synthetic Construct
agtaggcccttctcagcaagt

SEQ ID NO: 39873 - DNA, 22 bp, Artificial Sequence
  Synthetic Construct
ttggccttacccagtgtctaac

SEQ ID NO: 39874 - DNA, 23 bp, Artificial Sequence
  Synthetic Construct
tgtttctttgggaggagcacatt

SEQ ID NO: 39875 - DNA, 21 bp, Artificial Sequence
  Synthetic Construct
actcctcctgcctcccataca

SEQ ID NO: 39876 - DNA, 20 bp, Artificial Sequence
  Synthetic Construct
tccgtcctttgctgctgatg

SEQ ID NO: 39877 - DNA, 25 bp, Artificial Sequence
  Synthetic Construct
aatcccttgtcataccaagaaccaa

SEQ ID NO: 39878 - DNA, 20 bp, Artificial Sequence
  Synthetic Construct
taacgggctggctggcacta

SEQ ID NO: 39879 - DNA, 20 bp, Artificial Sequence
  Synthetic Construct
ttgggtggcatcctgcaatg

SEQ ID NO: 39880 - DNA, 22 bp, Artificial Sequence
  Synthetic Construct
ccacacattgcaccaactcact

SEQ ID NO: 39881 - DNA, 26 bp, Artificial Sequence
  Synthetic Construct
ggtcaacttacctggacgtatagaga

SEQ ID NO: 39882 - DNA, 21 bp, Artificial Sequence
  Synthetic Construct
gctggatgggcttacacactt

SEQ ID NO: 39883 - DNA, 21 bp, Artificial Sequence
  Synthetic Construct
gtgagcatggttggcagtgta

SEQ ID NO: 39884 - DNA, 22 bp, Artificial Sequence
  Synthetic Construct
ggggaggggatttcaggctttt

SEQ ID NO: 39885 - DNA, 23 bp, Artificial Sequence
  Synthetic Construct
gcctgggtttttctgctcacaac

SEQ ID NO: 39886 - DNA, 19 bp, Artificial Sequence
  Synthetic Construct
agctcagcagcagccaaac

SEQ ID NO: 39887 - DNA, 23 bp, Artificial Sequence
  Synthetic Construct
gcgtggccattttcctgaaccta

SEQ ID NO: 39888 - DNA, 24 bp, Artificial Sequence
  Synthetic Construct
gcacagtcttccaactgcctgaag

SEQ ID NO: 39889 - DNA, 24 bp, Artificial Sequence
  Synthetic Construct
tcacctaagtgcaccttactctct

SEQ ID NO: 39890 - DNA, 22 bp, Artificial Sequence
  Synthetic Construct
gccgccctacagattcctaact

SEQ ID NO: 39891 - DNA, 22 bp, Artificial Sequence
  Synthetic Construct
ctaaaactgggttcccgtcaca

SEQ ID NO: 39892 - DNA, 22 bp, Artificial Sequence
  Synthetic Construct
ggtttcaccaccgtgcagttac

SEQ ID NO: 39893 - DNA, 20 bp, Artificial Sequence
  Synthetic Construct
gaacctgcttgcctggttca

SEQ ID NO: 39894 - DNA, 25 bp, Artificial Sequence
  Synthetic Construct
tgtagtcttttcagactgccctttt

SEQ ID NO: 39895 - DNA, 24 bp, Artificial Sequence
  Synthetic Construct
ccacagttcatcccagtgctgaca

SEQ ID NO: 39896 - DNA, 23 bp, Artificial Sequence
  Synthetic Construct
cctccagaagaaccccaggacat

SEQ ID NO: 39897 - DNA, 25 bp, Artificial Sequence
  Synthetic Construct
tcaccaattctagtctccaggtttc

SEQ ID NO: 39898 - DNA, 22 bp, Artificial Sequence
  Synthetic Construct
ccatggaagggagacaccatgt

SEQ ID NO: 39899 - DNA, 25 bp, Artificial Sequence
  Synthetic Construct
tcatgtgggctgaccattaacttag

SEQ ID NO: 39900 - DNA, 24 bp, Artificial Sequence
  Synthetic Construct
gagcagagaccatgtcaggaaagt

SEQ ID NO: 39901 - DNA, 21 bp, Artificial Sequence
  Synthetic Construct
atggggatgggtcctccatgt

SEQ ID NO: 39902 - DNA, 21 bp, Artificial Sequence
  Synthetic Construct
gtacccaggctgtgggataga

SEQ ID NO: 39903 - DNA, 22 bp, Artificial Sequence
  Synthetic Construct
ccatctccaacttggggcacat

SEQ ID NO: 39904 - DNA, 25 bp, Artificial Sequence
  Synthetic Construct
ttgggacccagaatatggcataaaa

SEQ ID NO: 39905 - DNA, 20 bp, Artificial Sequence
  Synthetic Construct
tctaggctgcggtcagaaga

SEQ ID NO: 39906 - DNA, 26 bp, Artificial Sequence
  Synthetic Construct
gcagaacataacccctagttactaca

SEQ ID NO: 39907 - DNA, 22 bp, Artificial Sequence
  Synthetic Construct
gacacattagctgcctggcaaa

SEQ ID NO: 39908 - DNA, 20 bp, Artificial Sequence
  Synthetic Construct
gctgccagttgctctcaagt

SEQ ID NO: 39909 - DNA, 22 bp, Artificial Sequence
  Synthetic Construct
catcacagagtgtgggttgact

SEQ ID NO: 39910 - DNA, 20 bp, Artificial Sequence
  Synthetic Construct
aggcggcctaaagtctgtgt

SEQ ID NO: 39911 - DNA, 20 bp, Artificial Sequence
  Synthetic Construct
agctggggtttcacgacctt

SEQ ID NO: 39912 - DNA, 18 bp, Artificial Sequence
  Synthetic Construct
caccactgccaccaccat

SEQ ID NO: 39913 - DNA, 18 bp, Artificial Sequence
  Synthetic Construct
tgctgcaccctccctgaa

SEQ ID NO: 39914 - DNA, 23 bp, Artificial Sequence
  Synthetic Construct
ttcgagaagcaacttgacgtaga

SEQ ID NO: 39915 - DNA, 22 bp, Artificial Sequence
  Synthetic Construct
gtctagtgagggcccactttct

SEQ ID NO: 39916 - DNA, 24 bp, Artificial Sequence
  Synthetic Construct
ggctcaggggtaagaacagtggat

SEQ ID NO: 39917 - DNA, 24 bp, Artificial Sequence
  Synthetic Construct
gcagctctggagctctatggaagt

SEQ ID NO: 39918 - DNA, 25 bp, Artificial Sequence
  Synthetic Construct
tctcctccttactagctgtctcttc

SEQ ID NO: 39919 - DNA, 24 bp, Artificial Sequence
  Synthetic Construct
gctccttcctgattcctcacttca

SEQ ID NO: 39920 - DNA, 20 bp, Artificial Sequence
  Synthetic Construct
tgcaggaagccgtcactcat

SEQ ID NO: 39921 - DNA, 19 bp, Artificial Sequence
  Synthetic Construct
agcctgtgggcctcctaga

SEQ ID NO: 39922 - DNA, 26 bp, Artificial Sequence
  Synthetic Construct
ccaccgttttaacttgcactgacatc

SEQ ID NO: 39923 - DNA, 23 bp, Artificial Sequence
  Synthetic Construct
caagcaaaggctgaaccaaatga

SEQ ID NO: 39924 - DNA, 22 bp, Artificial Sequence
  Synthetic Construct
cctccttgacatgcttcaccaa

SEQ ID NO: 39925 - DNA, 20 bp, Artificial Sequence
  Synthetic Construct
gcgctaccaaggcacaaaga

SEQ ID NO: 39926 - DNA, 19 bp, Artificial Sequence
  Synthetic Construct
atgcctggctcaccgaagt

SEQ ID NO: 39927 - DNA, 21 bp, Artificial Sequence
  Synthetic Construct
ccttcaaagtgggcagaggaa

SEQ ID NO: 39928 - DNA, 27 bp, Artificial Sequence
  Synthetic Construct
ggccacagatatctcattgccagttac

SEQ ID NO: 39929 - DNA, 20 bp, Artificial Sequence
  Synthetic Construct
atacgcccctttccctctca

SEQ ID NO: 39930 - DNA, 20 bp, Artificial Sequence
  Synthetic Construct
cggagccctccaggctaaga

SEQ ID NO: 39931 - DNA, 24 bp, Artificial Sequence
  Synthetic Construct
ggcccaaagcaagggtatttcact

SEQ ID NO: 39932 - DNA, 19 bp, Artificial Sequence
  Synthetic Construct
agcctttccccagctgtct

SEQ ID NO: 39933 - DNA, 20 bp, Artificial Sequence
  Synthetic Construct
atcctctgggccttggtgaa

SEQ ID NO: 39934 - DNA, 25 bp, Artificial Sequence
  Synthetic Construct
gcatatcctacttctcggtggcttt

SEQ ID NO: 39935 - DNA, 22 bp, Artificial Sequence
  Synthetic Construct
gggttgcagaaacttggtgagt

SEQ ID NO: 39936 - DNA, 23 bp, Artificial Sequence
  Synthetic Construct
ggaaggaagagcaagcaagaagt

SEQ ID NO: 39937 - DNA, 26 bp, Artificial Sequence
  Synthetic Construct
gctgtggaaagcaagaagtacagttg

SEQ ID NO: 39938 - DNA, 20 bp, Artificial Sequence
  Synthetic Construct
caggcagcatcgtcttctct

SEQ ID NO: 39939 - DNA, 23 bp, Artificial Sequence
  Synthetic Construct
acccaactcagctcctgacttat

SEQ ID NO: 39940 - DNA, 23 bp, Artificial Sequence
  Synthetic Construct
aggtatcaaggggcatgctaaga

SEQ ID NO: 39941 - DNA, 23 bp, Artificial Sequence
  Synthetic Construct
tgccccaagaacaagtgaatcat

SEQ ID NO: 39942 - DNA, 25 bp, Artificial Sequence
  Synthetic Construct
tctcttccacccttagtcaagttca

SEQ ID NO: 39943 - DNA, 26 bp, Artificial Sequence
  Synthetic Construct
catacaacatggaagccttggataag

SEQ ID NO: 39944 - DNA, 21 bp, Artificial Sequence
  Synthetic Construct
gggctaagaggcaggaacaca

SEQ ID NO: 39945 - DNA, 24 bp, Artificial Sequence
  Synthetic Construct
gacatagttggagagcgactgaca

SEQ ID NO: 39946 - DNA, 26 bp, Artificial Sequence
  Synthetic Construct
ggacagagcttccggttatcctcttc

SEQ ID NO: 39947 - DNA, 22 bp, Artificial Sequence
  Synthetic Construct
cgacactgcacgtctcatcaca

SEQ ID NO: 39948 - DNA, 27 bp, Artificial Sequence
  Synthetic Construct
cctgaagccttattcctatcccttcat

SEQ ID NO: 39949 - DNA, 22 bp, Artificial Sequence
  Synthetic Construct
ttgagagtgacctgctgaggta

SEQ ID NO: 39950 - DNA, 23 bp, Artificial Sequence
  Synthetic Construct
cctttcatgatcaccggcagatt

SEQ ID NO: 39951 - DNA, 20 bp, Artificial Sequence
  Synthetic Construct
tggcctgtgtcacccagaaa

SEQ ID NO: 39952 - DNA, 20 bp, Artificial Sequence
  Synthetic Construct
tgctcacccactcccttgtt

SEQ ID NO: 39953 - DNA, 18 bp, Artificial Sequence
  Synthetic Construct
tggtgccagggcccataa

SEQ ID NO: 39954 - DNA, 21 bp, Artificial Sequence
  Synthetic Construct
tccatcctccggcttctactt

SEQ ID NO: 39955 - DNA, 20 bp, Artificial Sequence
  Synthetic Construct
gaatgggaagcagcggatca

SEQ ID NO: 39956 - DNA, 25 bp, Artificial Sequence
  Synthetic Construct
cctcagttggctgagtgagtgataa

SEQ ID NO: 39957 - DNA, 27 bp, Artificial Sequence
  Synthetic Construct
caccatctgccttgatcttatcctgta

SEQ ID NO: 39958 - DNA, 22 bp, Artificial Sequence
  Synthetic Construct
cctgtaccaggtctgggtgatg

SEQ ID NO: 39959 - DNA, 22 bp, Artificial Sequence
  Synthetic Construct
gacctgggtcaaatgccaccta

SEQ ID NO: 39960 - DNA, 22 bp, Artificial Sequence
  Synthetic Construct
ccccttgctcatcacgttgtgt

SEQ ID NO: 39961 - DNA, 22 bp, Artificial Sequence
  Synthetic Construct
cagagcttccctacacctgctt

SEQ ID NO: 39962 - DNA, 23 bp, Artificial Sequence
  Synthetic Construct
ggttatgcctgtcactgaccatt

SEQ ID NO: 39963 - DNA, 21 bp, Artificial Sequence
  Synthetic Construct
atcaaggtggggaggtgagat

SEQ ID NO: 39964 - DNA, 22 bp, Artificial Sequence
  Synthetic Construct
gcaagcaggcttgtctccgttt

SEQ ID NO: 39965 - DNA, 20 bp, Artificial Sequence
  Synthetic Construct
aaggggctggctggttttct

SEQ ID NO: 39966 - DNA, 22 bp, Artificial Sequence
  Synthetic Construct
ctctagagatccccgcatccat

SEQ ID NO: 39967 - DNA, 28 bp, Artificial Sequence
  Synthetic Construct
caccactgacatcatttttcaggtcttg

SEQ ID NO: 39968 - DNA, 21 bp, Artificial Sequence
  Synthetic Construct
acatcacttgttgggcagtga

SEQ ID NO: 39969 - DNA, 21 bp, Artificial Sequence
  Synthetic Construct
tcaggccctgtgtccgaaaga

SEQ ID NO: 39970 - DNA, 22 bp, Artificial Sequence
  Synthetic Construct
acactccaggtagcagggaaca

SEQ ID NO: 39971 - DNA, 20 bp, Artificial Sequence
  Synthetic Construct
gctctgcaaggcagcaattc

SEQ ID NO: 39972 - DNA, 22 bp, Artificial Sequence
  Synthetic Construct
gggagaatggctagctctctgt

SEQ ID NO: 39973 - DNA, 20 bp, Artificial Sequence
  Synthetic Construct
gcagagctggggtttgaact

SEQ ID NO: 39974 - DNA, 23 bp, Artificial Sequence
  Synthetic Construct
gccttgagtgctgaatgctgttc

SEQ ID NO: 39975 - DNA, 20 bp, Artificial Sequence
  Synthetic Construct
tccacgaggaccatccagtt

SEQ ID NO: 39976 - DNA, 25 bp, Artificial Sequence
  Synthetic Construct
cctgctttaggaatgcctgggatga

SEQ ID NO: 39977 - DNA, 25 bp, Artificial Sequence
  Synthetic Construct
cattgcccttaagtccctcctaatc

SEQ ID NO: 39978 - DNA, 22 bp, Artificial Sequence
  Synthetic Construct
gaagttgtggtgctctgaggat

SEQ ID NO: 39979 - DNA, 21 bp, Artificial Sequence
  Synthetic Construct
aaccaggtgctctcccaggaa

SEQ ID NO: 39980 - DNA, 22 bp, Artificial Sequence
  Synthetic Construct
ggatcctggcaaaaggatgtga

SEQ ID NO: 39981 - DNA, 20 bp, Artificial Sequence
  Synthetic Construct
cctgggccacttctctgact

SEQ ID NO: 39982 - DNA, 21 bp, Artificial Sequence
  Synthetic Construct
gtattgctggtggtgggttga

SEQ ID NO: 39983 - DNA, 18 bp, Artificial Sequence
  Synthetic Construct
cactgcacccagccgatt

SEQ ID NO: 39984 - DNA, 22 bp, Artificial Sequence
  Synthetic Construct
ggagccttctcccaatgtcagt

SEQ ID NO: 39985 - DNA, 22 bp, Artificial Sequence
  Synthetic Construct
gccacagcctggaaacatccat

SEQ ID NO: 39986 - DNA, 22 bp, Artificial Sequence
  Synthetic Construct
ggcaggttgctggaactggtta

SEQ ID NO: 39987 - DNA, 22 bp, Artificial Sequence
  Synthetic Construct
cttgcaacaccacagcatcatt

SEQ ID NO: 39988 - DNA, 20 bp, Artificial Sequence
  Synthetic Construct
ggcctcgcagaacagaggta

SEQ ID NO: 39989 - DNA, 23 bp, Artificial Sequence
  Synthetic Construct
ctgtttgtcacagtgggaaggaa

SEQ ID NO: 39990 - DNA, 23 bp, Artificial Sequence
  Synthetic Construct
tctagtctcactgttcccactgt

SEQ ID NO: 39991 - DNA, 26 bp, Artificial Sequence
  Synthetic Construct
gtgtcttggtaattcaatgcctgtag

SEQ ID NO: 39992 - DNA, 24 bp, Artificial Sequence
  Synthetic Construct
ccccacatgtctcctccaaacttc

SEQ ID NO: 39993 - DNA, 19 bp, Artificial Sequence
  Synthetic Construct
gaggtgagctggggagact

SEQ ID NO: 39994 - DNA, 25 bp, Artificial Sequence
  Synthetic Construct
gacacacatcctcaagttagagact

SEQ ID NO: 39995 - DNA, 24 bp, Artificial Sequence
  Synthetic Construct
cctgtttccacctcttgagtcttt

SEQ ID NO: 39996 - DNA, 18 bp, Artificial Sequence
  Synthetic Construct
gcactgtgcgaggcattg

SEQ ID NO: 39997 - DNA, 22 bp, Artificial Sequence
  Synthetic Construct
ttcccgtctgctaccgaagatg

SEQ ID NO: 39998 - DNA, 20 bp, Artificial Sequence
  Synthetic Construct
agaacacgcaggctctggaa

SEQ ID NO: 39999 - DNA, 24 bp, Artificial Sequence
  Synthetic Construct
gaacaattagaccttgcccacaaa

SEQ ID NO: 40000 - DNA, 22 bp, Artificial Sequence
  Synthetic Construct
cctccttcctttgggtctcaag

SEQ ID NO: 40001 - DNA, 20 bp, Artificial Sequence
  Synthetic Construct
agagctgagcagtggggatt

SEQ ID NO: 40002 - DNA, 22 bp, Artificial Sequence
  Synthetic Construct
ctgctaggtttccaagggcaaa

SEQ ID NO: 40003 - DNA, 21 bp, Artificial Sequence
  Synthetic Construct
gggagcaaatggggcaggtat

SEQ ID NO: 40004 - DNA, 22 bp, Artificial Sequence
  Synthetic Construct
gcaggttggctatggcttcact

SEQ ID NO: 40005 - DNA, 23 bp, Artificial Sequence
  Synthetic Construct
gtttgggacaagctgagttgaag

SEQ ID NO: 40006 - DNA, 25 bp, Artificial Sequence
  Synthetic Construct
tcatggataattgaccctgcagtag

SEQ ID NO: 40007 - DNA, 24 bp, Artificial Sequence
  Synthetic Construct
gcagatactgcctcatgtaactct

SEQ ID NO: 40008 - DNA, 23 bp, Artificial Sequence
  Synthetic Construct
gactcagccaatgcctcaatttc

SEQ ID NO: 40009 - DNA, 23 bp, Artificial Sequence
  Synthetic Construct
agctcccagatgatgcttctagt

SEQ ID NO: 40010 - DNA, 19 bp, Artificial Sequence
  Synthetic Construct
gcagtgttggtggctggaa

SEQ ID NO: 40011 - DNA, 22 bp, Artificial Sequence
  Synthetic Construct
ggggagggtgtttgtcatcagt

SEQ ID NO: 40012 - DNA, 20 bp, Artificial Sequence
  Synthetic Construct
gagatgcacggaaccgcatt

SEQ ID NO: 40013 - DNA, 23 bp, Artificial Sequence
  Synthetic Construct
agcagcctgaaccaactaaaaac

SEQ ID NO: 40014 - DNA, 21 bp, Artificial Sequence
  Synthetic Construct
ggaagggagcccctgttgaat

SEQ ID NO: 40015 - DNA, 22 bp, Artificial Sequence
  Synthetic Construct
agtgggatccctgcttttccta

SEQ ID NO: 40016 - DNA, 18 bp, Artificial Sequence
  Synthetic Construct
tctgcccggtgctttgtt

SEQ ID NO: 40017 - DNA, 24 bp, Artificial Sequence
  Synthetic Construct
ctcaactggggtcatggtttcaag

SEQ ID NO: 40018 - DNA, 24 bp, Artificial Sequence
  Synthetic Construct
ccgtgaatcctggctatgggagaa

SEQ ID NO: 40019 - DNA, 21 bp, Artificial Sequence
  Synthetic Construct
aaaggctccctgccctgtagt

SEQ ID NO: 40020 - DNA, 19 bp, Artificial Sequence
  Synthetic Construct
accccacccacctttctct

SEQ ID NO: 40021 - DNA, 24 bp, Artificial Sequence
  Synthetic Construct
ccctgctaagggaggaaagacagt

SEQ ID NO: 40022 - DNA, 26 bp, Artificial Sequence
  Synthetic Construct
gtatctccagatctagggagtaggtt

SEQ ID NO: 40023 - DNA, 20 bp, Artificial Sequence
  Synthetic Construct
cctcgcaaagcacctgaaga

SEQ ID NO: 40024 - DNA, 25 bp, Artificial Sequence
  Synthetic Construct
ggttaggatctcacctgcttgtttg

SEQ ID NO: 40025 - DNA, 19 bp, Artificial Sequence
  Synthetic Construct
tccccgcggaattcagtca

SEQ ID NO: 40026 - DNA, 22 bp, Artificial Sequence
  Synthetic Construct
gtgcatgaaacacaggctgaag

SEQ ID NO: 40027 - DNA, 22 bp, Artificial Sequence
  Synthetic Construct
ccctgccgaatttgcggttatc

SEQ ID NO: 40028 - DNA, 22 bp, Artificial Sequence
  Synthetic Construct
cctcagggtattgagggtggat

SEQ ID NO: 40029 - DNA, 25 bp, Artificial Sequence
  Synthetic Construct
gcttttctgagtaccaaccctcgta

SEQ ID NO: 40030 - DNA, 22 bp, Artificial Sequence
  Synthetic Construct
actgctgtaatccaagcaccaa

SEQ ID NO: 40031 - DNA, 22 bp, Artificial Sequence
  Synthetic Construct
gctcctacagcccttggcttat

SEQ ID NO: 40032 - DNA, 26 bp, Artificial Sequence
  Synthetic Construct
agaacttacaagggctccctattttc

SEQ ID NO: 40033 - DNA, 24 bp, Artificial Sequence
  Synthetic Construct
ggggcatcatagttgccctgagat

SEQ ID NO: 40034 - DNA, 22 bp, Artificial Sequence
  Synthetic Construct
aggaggacttggtaggcacaag

SEQ ID NO: 40035 - DNA, 22 bp, Artificial Sequence
  Synthetic Construct
ggagaagctaggaggtccgaat

SEQ ID NO: 40036 - DNA, 20 bp, Artificial Sequence
  Synthetic Construct
cagcttgtttgcccctggaa

SEQ ID NO: 40037 - DNA, 23 bp, Artificial Sequence
  Synthetic Construct
ccccaaagctaagcatgggaagt

SEQ ID NO: 40038 - DNA, 25 bp, Artificial Sequence
  Synthetic Construct
ccactgcttagaccaaccagctatg

SEQ ID NO: 40039 - DNA, 25 bp, Artificial Sequence
  Synthetic Construct
gtgttactgaagtgcaacaggagat

SEQ ID NO: 40040 - DNA, 27 bp, Artificial Sequence
  Synthetic Construct
gcttgctcaagtacattgtgtcaggtt

SEQ ID NO: 40041 - DNA, 20 bp, Artificial Sequence
  Synthetic Construct
aacaagcccaggccacaaag

SEQ ID NO: 40042 - DNA, 26 bp, Artificial Sequence
  Synthetic Construct
tggggtatgtctatgaacaggagtag

SEQ ID NO: 40043 - DNA, 26 bp, Artificial Sequence
  Synthetic Construct
gacagtgaatcagcagcttaaacaac

SEQ ID NO: 40044 - DNA, 21 bp, Artificial Sequence
  Synthetic Construct
gccagtgctggttgtgtcctt

SEQ ID NO: 40045 - DNA, 23 bp, Artificial Sequence
  Synthetic Construct
cccagaaacttgtcaacccgaat

SEQ ID NO: 40046 - DNA, 20 bp, Artificial Sequence
  Synthetic Construct
cccctcaaccccacatcaca

SEQ ID NO: 40047 - DNA, 25 bp, Artificial Sequence
  Synthetic Construct
gacttatcattccactccgctcaag

SEQ ID NO: 40048 - DNA, 24 bp, Artificial Sequence
  Synthetic Construct
ctccaacttcatcctggaatggtt

SEQ ID NO: 40049 - DNA, 20 bp, Artificial Sequence
  Synthetic Construct
tgggcttggccctgactttg

SEQ ID NO: 40050 - DNA, 21 bp, Artificial Sequence
  Synthetic Construct
cggaggatgacacaggcgtta

SEQ ID NO: 40051 - DNA, 22 bp, Artificial Sequence
  Synthetic Construct
gcccacttgtgtccctctgaat

SEQ ID NO: 40052 - DNA, 23 bp, Artificial Sequence
  Synthetic Construct
tctgggttgctgtcttctctaac

SEQ ID NO: 40053 - DNA, 22 bp, Artificial Sequence
  Synthetic Construct
cagattcacaggcatggtcaga

SEQ ID NO: 40054 - DNA, 26 bp, Artificial Sequence
  Synthetic Construct
gcttacattccctgtgatgctcttag

SEQ ID NO: 40055 - DNA, 22 bp, Artificial Sequence
  Synthetic Construct
ccaggttttgtgtgttgtgtgt

SEQ ID NO: 40056 - DNA, 21 bp, Artificial Sequence
  Synthetic Construct
gccccacagtgttttcctgtt

SEQ ID NO: 40057 - DNA, 21 bp, Artificial Sequence
  Synthetic Construct
ccaagctcactggggctgtta

SEQ ID NO: 40058 - DNA, 21 bp, Artificial Sequence
  Synthetic Construct
tgggacttcaggcttctgtga

SEQ ID NO: 40059 - DNA, 20 bp, Artificial Sequence
  Synthetic Construct
aagggctggtggggtggaaa

SEQ ID NO: 40060 - DNA, 22 bp, Artificial Sequence
  Synthetic Construct
ggtgattggacactgtcaggtt

SEQ ID NO: 40061 - DNA, 23 bp, Artificial Sequence
  Synthetic Construct
ctgataagtccaaccgcctcctt

SEQ ID NO: 40062 - DNA, 22 bp, Artificial Sequence
  Synthetic Construct
gaggcaatgagtcacaggctaa

SEQ ID NO: 40063 - DNA, 21 bp, Artificial Sequence
  Synthetic Construct
gcctgtcgagctaagaaggtt

SEQ ID NO: 40064 - DNA, 23 bp, Artificial Sequence
  Synthetic Construct
cacgtaaaatgtgctgcgtctga

SEQ ID NO: 40065 - DNA, 21 bp, Artificial Sequence
  Synthetic Construct
ctcacccagttccttggcttt

SEQ ID NO: 40066 - DNA, 24 bp, Artificial Sequence
  Synthetic Construct
ggcgttggtgtttggaagggatct

SEQ ID NO: 40067 - DNA, 21 bp, Artificial Sequence
  Synthetic Construct
tgatgcccagtctcactcaca

SEQ ID NO: 40068 - DNA, 22 bp, Artificial Sequence
  Synthetic Construct
gcagcaactaggggcatctgaa

SEQ ID NO: 40069 - DNA, 25 bp, Artificial Sequence
  Synthetic Construct
aaggctctggtctcattaattccat

SEQ ID NO: 40070 - DNA, 24 bp, Artificial Sequence
  Synthetic Construct
tcttggtttactaggggtggcata

SEQ ID NO: 40071 - DNA, 30 bp, Artificial Sequence
  Synthetic Construct
ggaaaagatagctttgatacctccagttac

SEQ ID NO: 40072 - DNA, 20 bp, Artificial Sequence
  Synthetic Construct
ttctggaggtgctggtgact

SEQ ID NO: 40073 - DNA, 25 bp, Artificial Sequence
  Synthetic Construct
acatcagagataagcacctcacttg

SEQ ID NO: 40074 - DNA, 23 bp, Artificial Sequence
  Synthetic Construct
cagctaccaccaagtgcttctga

SEQ ID NO: 40075 - DNA, 24 bp, Artificial Sequence
  Synthetic Construct
gttgtgaagtagcacacacactct

SEQ ID NO: 40076 - DNA, 23 bp, Artificial Sequence
  Synthetic Construct
ccattccttccccactcctgaat

SEQ ID NO: 40077 - DNA, 24 bp, Artificial Sequence
  Synthetic Construct
ggggtttctaaggcacttcaattc

SEQ ID NO: 40078 - DNA, 26 bp, Artificial Sequence
  Synthetic Construct
gggacaaagtctttacatgcagattc

SEQ ID NO: 40079 - DNA, 25 bp, Artificial Sequence
  Synthetic Construct
ggttaggattgagttgggcagattt

SEQ ID NO: 40080 - DNA, 23 bp, Artificial Sequence
  Synthetic Construct
gcccacactcaagcatctacatc

SEQ ID NO: 40081 - DNA, 25 bp, Artificial Sequence
  Synthetic Construct
ttggagaacttacagacagaagcat

SEQ ID NO: 40082 - DNA, 20 bp, Artificial Sequence
  Synthetic Construct
aggcacaccacgaaccttgt

SEQ ID NO: 40083 - DNA, 23 bp, Artificial Sequence
  Synthetic Construct
ggattgcacaaggagcagtggaa

SEQ ID NO: 40084 - DNA, 20 bp, Artificial Sequence
  Synthetic Construct
tgggagagggcacagctttt

SEQ ID NO: 40085 - DNA, 24 bp, Artificial Sequence
  Synthetic Construct
tctgaagatttggtaccccaggat

SEQ ID NO: 40086 - DNA, 25 bp, Artificial Sequence
  Synthetic Construct
ctcataccctcttggtcaccacatt

SEQ ID NO: 40087 - DNA, 20 bp, Artificial Sequence
  Synthetic Construct
aagcgaactggggagctttg

SEQ ID NO: 40088 - DNA, 24 bp, Artificial Sequence
  Synthetic Construct
cgttgctcctaaagccaagacaca

SEQ ID NO: 40089 - DNA, 19 bp, Artificial Sequence
  Synthetic Construct
tggcctgggttgccaggtt

SEQ ID NO: 40090 - DNA, 20 bp, Artificial Sequence
  Synthetic Construct
cctggaggctggcattgtgt

SEQ ID NO: 40091 - DNA, 27 bp, Artificial Sequence
  Synthetic Construct
gctacaagttaaatcctccgaccagat

SEQ ID NO: 40092 - DNA, 21 bp, Artificial Sequence
  Synthetic Construct
ccagctccaaacacaggaaca

SEQ ID NO: 40093 - DNA, 24 bp, Artificial Sequence
  Synthetic Construct
gcttcaaaatgcttcctgcaaact

SEQ ID NO: 40094 - DNA, 24 bp, Artificial Sequence
  Synthetic Construct
cggagtgtcagggtttcgctgtta

SEQ ID NO: 40095 - DNA, 26 bp, Artificial Sequence
  Synthetic Construct
tgcctattctatgggaagctatctct

SEQ ID NO: 40096 - DNA, 23 bp, Artificial Sequence
  Synthetic Construct
acagccagaatgccacataaaca

SEQ ID NO: 40097 - DNA, 21 bp, Artificial Sequence
  Synthetic Construct
tgcagggaatggggtaaggaa

SEQ ID NO: 40098 - DNA, 25 bp, Artificial Sequence
  Synthetic Construct
ctttgaggctagaaaacctgacctt

SEQ ID NO: 40099 - DNA, 21 bp, Artificial Sequence
  Synthetic Construct
tgtccttgagggaggacttga

SEQ ID NO: 40100 - DNA, 24 bp, Artificial Sequence
  Synthetic Construct
gtccctctaagctttcatctgtga

SEQ ID NO: 40101 - DNA, 22 bp, Artificial Sequence
  Synthetic Construct
tttcctctttggagcgtgaaca

SEQ ID NO: 40102 - DNA, 22 bp, Artificial Sequence
  Synthetic Construct
gcaacctgaatgccctctcctt

SEQ ID NO: 40103 - DNA, 23 bp, Artificial Sequence
  Synthetic Construct
gctcaatgcattcacaggacaaa

SEQ ID NO: 40104 - DNA, 24 bp, Artificial Sequence
  Synthetic Construct
gggtgtaaatgacagctccaccat

SEQ ID NO: 40105 - DNA, 23 bp, Artificial Sequence
  Synthetic Construct
ccctttcactccaccctgttgat

SEQ ID NO: 40106 - DNA, 18 bp, Artificial Sequence
  Synthetic Construct
tgcccagtggcagccata

SEQ ID NO: 40107 - DNA, 19 bp, Artificial Sequence
  Synthetic Construct
tggacttccccagctcgtt

SEQ ID NO: 40108 - DNA, 22 bp, Artificial Sequence
  Synthetic Construct
ggcaaacatcccctgcttctct

SEQ ID NO: 40109 - DNA, 24 bp, Artificial Sequence
  Synthetic Construct
tgcatagctccttatcccactttg

SEQ ID NO: 40110 - DNA, 19 bp, Artificial Sequence
  Synthetic Construct
tcgtgggcaggcagtagta

SEQ ID NO: 40111 - DNA, 25 bp, Artificial Sequence
  Synthetic Construct
cctgggaactttctggttgccatag

SEQ ID NO: 40112 - DNA, 27 bp, Artificial Sequence
  Synthetic Construct
caattaagcatcacagtgtctgtccta

SEQ ID NO: 40113 - DNA, 18 bp, Artificial Sequence
  Synthetic Construct
tgtccagctgcggtgagt

SEQ ID NO: 40114 - DNA, 20 bp, Artificial Sequence
  Synthetic Construct
gccagtggctcctgatctga

SEQ ID NO: 40115 - DNA, 22 bp, Artificial Sequence
  Synthetic Construct
gctcccctgagattgtggtgaa

SEQ ID NO: 40116 - DNA, 23 bp, Artificial Sequence
  Synthetic Construct
tcttcaattgcctcaaggcctaa

SEQ ID NO: 40117 - DNA, 25 bp, Artificial Sequence
  Synthetic Construct
ccaagtaattctgcccctcctcctt

SEQ ID NO: 40118 - DNA, 22 bp, Artificial Sequence
  Synthetic Construct
ccctcgcaaccaaacaccctta

SEQ ID NO: 40119 - DNA, 24 bp, Artificial Sequence
  Synthetic Construct
tggtgttcggaagtctatgtttga

SEQ ID NO: 40120 - DNA, 29 bp, Artificial Sequence
  Synthetic Construct
gctgagtagaatagctcaggttgtaggta

SEQ ID NO: 40121 - DNA, 20 bp, Artificial Sequence
  Synthetic Construct
tccacagccccatcccattt

SEQ ID NO: 40122 - DNA, 26 bp, Artificial Sequence
  Synthetic Construct
gaaggctgtcaaactgctaatcttac

SEQ ID NO: 40123 - DNA, 25 bp, Artificial Sequence
  Synthetic Construct
ggagcatgtaagctagtgagccatt

SEQ ID NO: 40124 - DNA, 21 bp, Artificial Sequence
  Synthetic Construct
atgcggaggtccgtcctatgt

SEQ ID NO: 40125 - DNA, 22 bp, Artificial Sequence
  Synthetic Construct
tcaggagtccaggtgaggctta

SEQ ID NO: 40126 - DNA, 20 bp, Artificial Sequence
  Synthetic Construct
agctgttgcagccctctact

SEQ ID NO: 40127 - DNA, 23 bp, Artificial Sequence
  Synthetic Construct
ggatagtggaaactgccgtggaa

SEQ ID NO: 40128 - DNA, 23 bp, Artificial Sequence
  Synthetic Construct
aggcctgaagatatgaccaccta

SEQ ID NO: 40129 - DNA, 25 bp, Artificial Sequence
  Synthetic Construct
ccagagctgtagcattttcactact

SEQ ID NO: 40130 - DNA, 22 bp, Artificial Sequence
  Synthetic Construct
aggctgtcaccacactctcaag

SEQ ID NO: 40131 - DNA, 20 bp, Artificial Sequence
  Synthetic Construct
gttccccaggaggtgtcaga

SEQ ID NO: 40132 - DNA, 22 bp, Artificial Sequence
  Synthetic Construct
tcactggagtgagtgcctctat

SEQ ID NO: 40133 - DNA, 22 bp, Artificial Sequence
  Synthetic Construct
gccaaagcagcactgtaagttg

SEQ ID NO: 40134 - DNA, 20 bp, Artificial Sequence
  Synthetic Construct
ggagccaggtgggatgcttt

SEQ ID NO: 40135 - DNA, 22 bp, Artificial Sequence
  Synthetic Construct
ccatgacctgtggggttctgtt

SEQ ID NO: 40136 - DNA, 20 bp, Artificial Sequence
  Synthetic Construct
aggccactcctggccatcaa

SEQ ID NO: 40137 - DNA, 25 bp, Artificial Sequence
  Synthetic Construct
ggagaaacagagaagaacaccattg

SEQ ID NO: 40138 - DNA, 21 bp, Artificial Sequence
  Synthetic Construct
gccagatgatcaagccactct

SEQ ID NO: 40139 - DNA, 21 bp, Artificial Sequence
  Synthetic Construct
ctgggactccatcctctctca

SEQ ID NO: 40140 - DNA, 20 bp, Artificial Sequence
  Synthetic Construct
cacggagacgctctcccata

SEQ ID NO: 40141 - DNA, 21 bp, Artificial Sequence
  Synthetic Construct
agagaaaaccgtggcacagaa

SEQ ID NO: 40142 - DNA, 22 bp, Artificial Sequence
  Synthetic Construct
tggtcaaggactgccaagacta

SEQ ID NO: 40143 - DNA, 26 bp, Artificial Sequence
  Synthetic Construct
agcacaaggagagtagggatttttac

SEQ ID NO: 40144 - DNA, 25 bp, Artificial Sequence
  Synthetic Construct
gtttccaggagtttcacgaacctaa

SEQ ID NO: 40145 - DNA, 21 bp, Artificial Sequence
  Synthetic Construct
aagactgtggcccagctccat

SEQ ID NO: 40146 - DNA, 21 bp, Artificial Sequence
  Synthetic Construct
aagtggtggaagggccaggta

SEQ ID NO: 40147 - DNA, 20 bp, Artificial Sequence
  Synthetic Construct
aacctcacaacccgcagtgt

SEQ ID NO: 40148 - DNA, 24 bp, Artificial Sequence
  Synthetic Construct
acagagaacaggtacagccatact

SEQ ID NO: 40149 - DNA, 22 bp, Artificial Sequence
  Synthetic Construct
tcagctagccactgggagatgt

SEQ ID NO: 40150 - DNA, 27 bp, Artificial Sequence
  Synthetic Construct
cgtgtgctaatgaggaaaagagagctt

SEQ ID NO: 40151 - DNA, 21 bp, Artificial Sequence
  Synthetic Construct
tctaatggggcagggcctttg

SEQ ID NO: 40152 - DNA, 24 bp, Artificial Sequence
  Synthetic Construct
ccactcctccttcacctcctttct

SEQ ID NO: 40153 - DNA, 21 bp, Artificial Sequence
  Synthetic Construct
atggcgcaggtcgggagtgat

SEQ ID NO: 40154 - DNA, 20 bp, Artificial Sequence
  Synthetic Construct
tgtgtggagcccaggactga

SEQ ID NO: 40155 - DNA, 23 bp, Artificial Sequence
  Synthetic Construct
tcccgaaattcatctctgcactt

SEQ ID NO: 40156 - DNA, 26 bp, Artificial Sequence
  Synthetic Construct
tgatctgatcttggatgtgaggacta

SEQ ID NO: 40157 - DNA, 24 bp, Artificial Sequence
  Synthetic Construct
gtccctaacaccatgttgcctctt

SEQ ID NO: 40158 - DNA, 26 bp, Artificial Sequence
  Synthetic Construct
gcttctgagtgcttccttttcagtgt

SEQ ID NO: 40159 - DNA, 25 bp, Artificial Sequence
  Synthetic Construct
aatgggattatcatgtgcctcagaa

SEQ ID NO: 40160 - DNA, 25 bp, Artificial Sequence
  Synthetic Construct
tggggtagtgaaggattgattcaga

SEQ ID NO: 40161 - DNA, 26 bp, Artificial Sequence
  Synthetic Construct
ggtcaggaaccaagtttaggctttag

SEQ ID NO: 40162 - DNA, 23 bp, Artificial Sequence
  Synthetic Construct
gaaagagtcacccatagcacaga

SEQ ID NO: 40163 - DNA, 22 bp, Artificial Sequence
  Synthetic Construct
ttgttttgcaggggttggtttc

SEQ ID NO: 40164 - DNA, 27 bp, Artificial Sequence
  Synthetic Construct
ctgcagagaaatctgtcatcactctgt

SEQ ID NO: 40165 - DNA, 25 bp, Artificial Sequence
  Synthetic Construct
ggacaagaacaagtgcgagaagaag

SEQ ID NO: 40166 - DNA, 22 bp, Artificial Sequence
  Synthetic Construct
cggttttctcctggtggtttga

SEQ ID NO: 40167 - DNA, 22 bp, Artificial Sequence
  Synthetic Construct
cacggctggatgtctcatcaac

SEQ ID NO: 40168 - DNA, 25 bp, Artificial Sequence
  Synthetic Construct
ctggggtccagtaaggagtatgttt

SEQ ID NO: 40169 - DNA, 26 bp, Artificial Sequence
  Synthetic Construct
caaattctaactctcacaccccttgt

SEQ ID NO: 40170 - DNA, 22 bp, Artificial Sequence
  Synthetic Construct
ccggtggggctaagattctaac

SEQ ID NO: 40171 - DNA, 23 bp, Artificial Sequence
  Synthetic Construct
taccgcaaggcaatagacagcat

SEQ ID NO: 40172 - DNA, 20 bp, Artificial Sequence
  Synthetic Construct
ggcatagccagcaggaatgt

SEQ ID NO: 40173 - DNA, 20 bp, Artificial Sequence
  Synthetic Construct
tcctggggtctgcagcagtt

SEQ ID NO: 40174 - DNA, 22 bp, Artificial Sequence
  Synthetic Construct
gagcagaccctcctgaagatgt

SEQ ID NO: 40175 - DNA, 22 bp, Artificial Sequence
  Synthetic Construct
gctgaagtgcaagaggatcgta

SEQ ID NO: 40176 - DNA, 22 bp, Artificial Sequence
  Synthetic Construct
cctgggatgggaaactggtgtt

SEQ ID NO: 40177 - DNA, 25 bp, Artificial Sequence
  Synthetic Construct
gttagttagttcctcctgcctgaag

SEQ ID NO: 40178 - DNA, 25 bp, Artificial Sequence
  Synthetic Construct
ccaaattgtgactagaccccagaca

SEQ ID NO: 40179 - DNA, 25 bp, Artificial Sequence
  Synthetic Construct
gagttgtttcatttggctcaagtct

SEQ ID NO: 40180 - DNA, 23 bp, Artificial Sequence
  Synthetic Construct
gctcatgaactgtaggcccttct

SEQ ID NO: 40181 - DNA, 25 bp, Artificial Sequence
  Synthetic Construct
ttagcccaagtacaggactttcttt

SEQ ID NO: 40182 - DNA, 30 bp, Artificial Sequence
  Synthetic Construct
ccactagataacaatagcacctaccagttg

SEQ ID NO: 40183 - DNA, 22 bp, Artificial Sequence
  Synthetic Construct
gccctgtaggaccagttcactt

SEQ ID NO: 40184 - DNA, 23 bp, Artificial Sequence
  Synthetic Construct
ccacagttaacctgctcatggaa

SEQ ID NO: 40185 - DNA, 27 bp, Artificial Sequence
  Synthetic Construct
gctcctgatgaaatttttcagcgtctt

SEQ ID NO: 40186 - DNA, 21 bp, Artificial Sequence
  Synthetic Construct
agccgattggtgtcagacatt

SEQ ID NO: 40187 - DNA, 26 bp, Artificial Sequence
  Synthetic Construct
gatgagaagagtcagatcaacccatt

SEQ ID NO: 40188 - DNA, 29 bp, Artificial Sequence
  Synthetic Construct
gggctatgaattaaggagaaatgctgttg

SEQ ID NO: 40189 - DNA, 22 bp, Artificial Sequence
  Synthetic Construct
cacctctatgtggggctgttag

SEQ ID NO: 40190 - DNA, 26 bp, Artificial Sequence
  Synthetic Construct
gcttaggtgaaggagaataaccatga

SEQ ID NO: 40191 - DNA, 21 bp, Artificial Sequence
  Synthetic Construct
tcagagggttccccagatcaa

SEQ ID NO: 40192 - DNA, 26 bp, Artificial Sequence
  Synthetic Construct
tgtctctcatcctaccttgactctta

SEQ ID NO: 40193 - DNA, 25 bp, Artificial Sequence
  Synthetic Construct
ggaccaaaccaactgaaaacctgta

SEQ ID NO: 40194 - DNA, 21 bp, Artificial Sequence
  Synthetic Construct
agaggcagggtttggggtaga

SEQ ID NO: 40195 - DNA, 24 bp, Artificial Sequence
  Synthetic Construct
ttgactccatgtccactgttttct

SEQ ID NO: 40196 - DNA, 21 bp, Artificial Sequence
  Synthetic Construct
ttcagtgggagggagagttga

SEQ ID NO: 40197 - DNA, 23 bp, Artificial Sequence
  Synthetic Construct
ccagatgactgcttctccagcat

SEQ ID NO: 40198 - DNA, 22 bp, Artificial Sequence
  Synthetic Construct
ggaaagacagaggacgaggttt

SEQ ID NO: 40199 - DNA, 20 bp, Artificial Sequence
  Synthetic Construct
gctggaaaaccaggggaact

SEQ ID NO: 40200 - DNA, 22 bp, Artificial Sequence
  Synthetic Construct
tgcagacatggggaaggcctaa

SEQ ID NO: 40201 - DNA, 24 bp, Artificial Sequence
  Synthetic Construct
gccaagattgagcagcatttcctt

SEQ ID NO: 40202 - DNA, 24 bp, Artificial Sequence
  Synthetic Construct
acaaacacttgctacactgagaga

SEQ ID NO: 40203 - DNA, 20 bp, Artificial Sequence
  Synthetic Construct
ttcgtcacgctggtggtgtt

SEQ ID NO: 40204 - DNA, 20 bp, Artificial Sequence
  Synthetic Construct
ccacctgggaacgactctga

SEQ ID NO: 40205 - DNA, 25 bp, Artificial Sequence
  Synthetic Construct
ggcaagtactattctgtgggaggat

SEQ ID NO: 40206 - DNA, 27 bp, Artificial Sequence
  Synthetic Construct
tttgtacagggctggtactatgataag

SEQ ID NO: 40207 - DNA, 25 bp, Artificial Sequence
  Synthetic Construct
gctgaggttttcacattgggactga

SEQ ID NO: 40208 - DNA, 19 bp, Artificial Sequence
  Synthetic Construct
gctgcggaccccgtttagt

SEQ ID NO: 40209 - DNA, 24 bp, Artificial Sequence
  Synthetic Construct
gctgcctttattaagcccctactt

SEQ ID NO: 40210 - DNA, 24 bp, Artificial Sequence
  Synthetic Construct
gttagcacagctgacctaggatac

SEQ ID NO: 40211 - DNA, 25 bp, Artificial Sequence
  Synthetic Construct
agagaagaatgtactggcgaagaaa

SEQ ID NO: 40212 - DNA, 20 bp, Artificial Sequence
  Synthetic Construct
tgccaagggccggactaaca

SEQ ID NO: 40213 - DNA, 20 bp, Artificial Sequence
  Synthetic Construct
agtatcgggcctccttgtgt

SEQ ID NO: 40214 - DNA, 22 bp, Artificial Sequence
  Synthetic Construct
gaggcaaatatcagcccagtga

SEQ ID NO: 40215 - DNA, 21 bp, Artificial Sequence
  Synthetic Construct
tgggagcctcacctgtctttg

SEQ ID NO: 40216 - DNA, 24 bp, Artificial Sequence
  Synthetic Construct
catttcaaaggcagtgtgggtaga

SEQ ID NO: 40217 - DNA, 25 bp, Artificial Sequence
  Synthetic Construct
ccttccacgtcattccactggtcta

SEQ ID NO: 40218 - DNA, 21 bp, Artificial Sequence
  Synthetic Construct
ggacttgccagggaagctact

SEQ ID NO: 40219 - DNA, 24 bp, Artificial Sequence
  Synthetic Construct
acataaagccaaggacagatgtga

SEQ ID NO: 40220 - DNA, 19 bp, Artificial Sequence
  Synthetic Construct
gcagcagcccagggttaaa

SEQ ID NO: 40221 - DNA, 22 bp, Artificial Sequence
  Synthetic Construct
gccacaaacctccactcctaac

SEQ ID NO: 40222 - DNA, 23 bp, Artificial Sequence
  Synthetic Construct
ccttctaggcctctaagctggtt

SEQ ID NO: 40223 - DNA, 22 bp, Artificial Sequence
  Synthetic Construct
tcctgcacgtgaagaagaaaga

SEQ ID NO: 40224 - DNA, 24 bp, Artificial Sequence
  Synthetic Construct
cctctctggaaaactggcccaata

SEQ ID NO: 40225 - DNA, 22 bp, Artificial Sequence
  Synthetic Construct
gtccctggggcaaaagttgaga

SEQ ID NO: 40226 - DNA, 20 bp, Artificial Sequence
  Synthetic Construct
ggagcttctggcatccagtt

SEQ ID NO: 40227 - DNA, 24 bp, Artificial Sequence
  Synthetic Construct
actatggagcaccaggatgtatga

SEQ ID NO: 40228 - DNA, 21 bp, Artificial Sequence
  Synthetic Construct
tcgacgacaccactggagaca

SEQ ID NO: 40229 - DNA, 22 bp, Artificial Sequence
  Synthetic Construct
ctgcagagtgcccttgaacttg

SEQ ID NO: 40230 - DNA, 23 bp, Artificial Sequence
  Synthetic Construct
gctttagctactgtggtcacctt

SEQ ID NO: 40231 - DNA, 20 bp, Artificial Sequence
  Synthetic Construct
agccagcagagcgtggagat

SEQ ID NO: 40232 - DNA, 21 bp, Artificial Sequence
  Synthetic Construct
ggcaaagcatccacccatctt

SEQ ID NO: 40233 - DNA, 21 bp, Artificial Sequence
  Synthetic Construct
tgagcctgccaccagatggat

SEQ ID NO: 40234 - DNA, 24 bp, Artificial Sequence
  Synthetic Construct
ggggagaaattccagcttctgtga

SEQ ID NO: 40235 - DNA, 26 bp, Artificial Sequence
  Synthetic Construct
agccatatgtctctttgaggaagaac

SEQ ID NO: 40236 - DNA, 23 bp, Artificial Sequence
  Synthetic Construct
cccctactcccatgtcactcctt

SEQ ID NO: 40237 - DNA, 27 bp, Artificial Sequence
  Synthetic Construct
cccttgtgtaagagtcccttgtgtaag

SEQ ID NO: 40238 - DNA, 24 bp, Artificial Sequence
  Synthetic Construct
ctcccactatcactgggaatgagt

SEQ ID NO: 40239 - DNA, 26 bp, Artificial Sequence
  Synthetic Construct
gcccacatttctaccctctgattatg

SEQ ID NO: 40240 - DNA, 25 bp, Artificial Sequence
  Synthetic Construct
gatagtaatgcagctcttcgagtca

SEQ ID NO: 40241 - DNA, 22 bp, Artificial Sequence
  Synthetic Construct
gcccagattcaactggccacaa

SEQ ID NO: 40242 - DNA, 23 bp, Artificial Sequence
  Synthetic Construct
acaacaaacatgggacctgaaca

SEQ ID NO: 40243 - DNA, 23 bp, Artificial Sequence
  Synthetic Construct
aataggacctgagcgagttgaag

SEQ ID NO: 40244 - DNA, 19 bp, Artificial Sequence
  Synthetic Construct
tcacccagcagctttgctt

SEQ ID NO: 40245 - DNA, 20 bp, Artificial Sequence
  Synthetic Construct
cacacacaccccaggctagt

SEQ ID NO: 40246 - DNA, 21 bp, Artificial Sequence
  Synthetic Construct
tcctagcctgtgcccaacctt

SEQ ID NO: 40247 - DNA, 22 bp, Artificial Sequence
  Synthetic Construct
gcaccttaagagctgggtctgt

SEQ ID NO: 40248 - DNA, 20 bp, Artificial Sequence
  Synthetic Construct
tcccacaccaaaccccaagt

SEQ ID NO: 40249 - DNA, 21 bp, Artificial Sequence
  Synthetic Construct
aggcttcttggcccctcctaa

SEQ ID NO: 40250 - DNA, 22 bp, Artificial Sequence
  Synthetic Construct
tgtctacctctctgccacttct

SEQ ID NO: 40251 - DNA, 19 bp, Artificial Sequence
  Synthetic Construct
agggtgtggggctgcagat

SEQ ID NO: 40252 - DNA, 23 bp, Artificial Sequence
  Synthetic Construct
ctgtgtctgagcaaggtctgctt

SEQ ID NO: 40253 - DNA, 24 bp, Artificial Sequence
  Synthetic Construct
ccagcagagatggactggagtttc

SEQ ID NO: 40254 - DNA, 22 bp, Artificial Sequence
  Synthetic Construct
ggattccagaatgtgcgtggat

SEQ ID NO: 40255 - DNA, 19 bp, Artificial Sequence
  Synthetic Construct
cgaaccccgtttgccttca

SEQ ID NO: 40256 - DNA, 23 bp, Artificial Sequence
  Synthetic Construct
ccgaaatcaaggcatcagcagta

SEQ ID NO: 40257 - DNA, 20 bp, Artificial Sequence
  Synthetic Construct
agttcacggttccccacatc

SEQ ID NO: 40258 - DNA, 22 bp, Artificial Sequence
  Synthetic Construct
ggaggctcctaagctgcatttg

SEQ ID NO: 40259 - DNA, 21 bp, Artificial Sequence
  Synthetic Construct
gtcatggtggactctgtgctt

SEQ ID NO: 40260 - DNA, 20 bp, Artificial Sequence
  Synthetic Construct
ggtaagaacccggcctcaca

SEQ ID NO: 40261 - DNA, 24 bp, Artificial Sequence
  Synthetic Construct
gaatattcctctcctgaccacgtt

SEQ ID NO: 40262 - DNA, 21 bp, Artificial Sequence
  Synthetic Construct
gctaacgctggaacagacctt

SEQ ID NO: 40263 - DNA, 22 bp, Artificial Sequence
  Synthetic Construct
cggtgttacactggctttggaa

SEQ ID NO: 40264 - DNA, 25 bp, Artificial Sequence
  Synthetic Construct
gatgaaatcctaacagcgaggaaag

SEQ ID NO: 40265 - DNA, 22 bp, Artificial Sequence
  Synthetic Construct
cgttcttcccgtggtggaaaca

SEQ ID NO: 40266 - DNA, 23 bp, Artificial Sequence
  Synthetic Construct
cagtcctaaaggagtccgtgtca

SEQ ID NO: 40267 - DNA, 19 bp, Artificial Sequence
  Synthetic Construct
tgctggcaaaagccacgta

SEQ ID NO: 40268 - DNA, 25 bp, Artificial Sequence
  Synthetic Construct
gacatccaaaactgtgtggagagta

SEQ ID NO: 40269 - DNA, 20 bp, Artificial Sequence
  Synthetic Construct
tgaaactggggcagccattg

SEQ ID NO: 40270 - DNA, 23 bp, Artificial Sequence
  Synthetic Construct
agaatttcaagtgaggccctgaa

SEQ ID NO: 40271 - DNA, 19 bp, Artificial Sequence
  Synthetic Construct
ggccacgtgacccctctta

SEQ ID NO: 40272 - DNA, 24 bp, Artificial Sequence
  Synthetic Construct
gctgacttggtttcacctgtacta

SEQ ID NO: 40273 - DNA, 25 bp, Artificial Sequence
  Synthetic Construct
gtgtgagaaggattctacccactgt

SEQ ID NO: 40274 - DNA, 23 bp, Artificial Sequence
  Synthetic Construct
gctagaactactcaggggccttt

SEQ ID NO: 40275 - DNA, 23 bp, Artificial Sequence
  Synthetic Construct
tgtctctgagatgagcctctgta

SEQ ID NO: 40276 - DNA, 23 bp, Artificial Sequence
  Synthetic Construct
gggcttcatgtccacctcagaaa

SEQ ID NO: 40277 - DNA, 20 bp, Artificial Sequence
  Synthetic Construct
agctcactcacgggctctgt

SEQ ID NO: 40278 - DNA, 21 bp, Artificial Sequence
  Synthetic Construct
acgtgctgtctgtttgtcaga

SEQ ID NO: 40279 - DNA, 25 bp, Artificial Sequence
  Synthetic Construct
ccctcatgcaaagcacttgctcaca

SEQ ID NO: 40280 - DNA, 20 bp, Artificial Sequence
  Synthetic Construct
ttcctctggccctccctttt

SEQ ID NO: 40281 - DNA, 25 bp, Artificial Sequence
  Synthetic Construct
tttggtttgactatgggccatttac

SEQ ID NO: 40282 - DNA, 20 bp, Artificial Sequence
  Synthetic Construct
tagactggcagggagtgtgt

SEQ ID NO: 40283 - DNA, 18 bp, Artificial Sequence
  Synthetic Construct
aggcaggggtcacaccaa

SEQ ID NO: 40284 - DNA, 24 bp, Artificial Sequence
  Synthetic Construct
ccctgtggaatccctacattcaag

SEQ ID NO: 40285 - DNA, 19 bp, Artificial Sequence
  Synthetic Construct
tggatggcgcttgctgact

SEQ ID NO: 40286 - DNA, 19 bp, Artificial Sequence
  Synthetic Construct
acacggccatggcttcaca

SEQ ID NO: 40287 - DNA, 22 bp, Artificial Sequence
  Synthetic Construct
ggcctgttaaccagcactggaa

SEQ ID NO: 40288 - DNA, 20 bp, Artificial Sequence
  Synthetic Construct
agccagagcagctgaacagt

SEQ ID NO: 40289 - DNA, 19 bp, Artificial Sequence
  Synthetic Construct
tgcctggacacgtggcttt

SEQ ID NO: 40290 - DNA, 26 bp, Artificial Sequence
  Synthetic Construct
gagggaatgattagggaagttcatct

SEQ ID NO: 40291 - DNA, 21 bp, Artificial Sequence
  Synthetic Construct
ctgatgtgcatggaggccaaa

SEQ ID NO: 40292 - DNA, 20 bp, Artificial Sequence
  Synthetic Construct
gcagtgctggcaactggaaa

SEQ ID NO: 40293 - DNA, 19 bp, Artificial Sequence
  Synthetic Construct
cctccctccagcaccatct

SEQ ID NO: 40294 - DNA, 27 bp, Artificial Sequence
  Synthetic Construct
cctttgggtaaatatgaaggagcacaa

SEQ ID NO: 40295 - DNA, 25 bp, Artificial Sequence
  Synthetic Construct
gtctcaggaaaacacgtgataccaa

SEQ ID NO: 40296 - DNA, 19 bp, Artificial Sequence
  Synthetic Construct
ggggagctcaccaggaagt

SEQ ID NO: 40297 - DNA, 24 bp, Artificial Sequence
  Synthetic Construct
ggcactgctcagattctccctgta

SEQ ID NO: 40298 - DNA, 20 bp, Artificial Sequence
  Synthetic Construct
caaccctggttgctctgtca

SEQ ID NO: 40299 - DNA, 21 bp, Artificial Sequence
  Synthetic Construct
tgtgctgctagcgaggggtat

SEQ ID NO: 40300 - DNA, 26 bp, Artificial Sequence
  Synthetic Construct
cacaaattaggtagcctgtcctgtgt

SEQ ID NO: 40301 - DNA, 22 bp, Artificial Sequence
  Synthetic Construct
acctccaggatgcaagccaaag

SEQ ID NO: 40302 - DNA, 22 bp, Artificial Sequence
  Synthetic Construct
ggggacatctggggatgaatct

SEQ ID NO: 40303 - DNA, 22 bp, Artificial Sequence
  Synthetic Construct
aggctccaacagcgataacttc

SEQ ID NO: 40304 - DNA, 20 bp, Artificial Sequence
  Synthetic Construct
tcccaggaccagcctctact

SEQ ID NO: 40305 - DNA, 24 bp, Artificial Sequence
  Synthetic Construct
gccctgattgctgtaacctagatg

SEQ ID NO: 40306 - DNA, 24 bp, Artificial Sequence
  Synthetic Construct
gacttcagagccagctttttgcta

SEQ ID NO: 40307 - DNA, 28 bp, Artificial Sequence
  Synthetic Construct
ccatgataggagttttgataggggttag

SEQ ID NO: 40308 - DNA, 29 bp, Artificial Sequence
  Synthetic Construct
ggactaataggatggagagacaatcaact

SEQ ID NO: 40309 - DNA, 25 bp, Artificial Sequence
  Synthetic Construct
tcatgtcatccctcttttccctact

SEQ ID NO: 40310 - DNA, 22 bp, Artificial Sequence
  Synthetic Construct
tcaaccacacacttggccataa

SEQ ID NO: 40311 - DNA, 20 bp, Artificial Sequence
  Synthetic Construct
tcccggtattcgtcgctaga

SEQ ID NO: 40312 - DNA, 21 bp, Artificial Sequence
  Synthetic Construct
gctcaggtgaatgctgccaaa

SEQ ID NO: 40313 - DNA, 21 bp, Artificial Sequence
  Synthetic Construct
gctgggcttgctgtgaaaaag

SEQ ID NO: 40314 - DNA, 21 bp, Artificial Sequence
  Synthetic Construct
gactgggtgtgtggactttca

SEQ ID NO: 40315 - DNA, 22 bp, Artificial Sequence
  Synthetic Construct
tgccaaggtcatcctcctaact

SEQ ID NO: 40316 - DNA, 23 bp, Artificial Sequence
  Synthetic Construct
acattctgccaaggggacattta

SEQ ID NO: 40317 - DNA, 27 bp, Artificial Sequence
  Synthetic Construct
ggctaacaggaaacctctaagacttta

SEQ ID NO: 40318 - DNA, 21 bp, Artificial Sequence
  Synthetic Construct
gcagggctgggagtggtaaaa

SEQ ID NO: 40319 - DNA, 26 bp, Artificial Sequence
  Synthetic Construct
ggagaatgtcctcacaaggtgtcagt

SEQ ID NO: 40320 - DNA, 21 bp, Artificial Sequence
  Synthetic Construct
tggggaacactgcctgcagaa

SEQ ID NO: 40321 - DNA, 22 bp, Artificial Sequence
  Synthetic Construct
cccagggtaaggggaggaacat

SEQ ID NO: 40322 - DNA, 20 bp, Artificial Sequence
  Synthetic Construct
cagtgggtggcttcaggaat

SEQ ID NO: 40323 - DNA, 24 bp, Artificial Sequence
  Synthetic Construct
gccctgtggttctaggatctgtct

SEQ ID NO: 40324 - DNA, 24 bp, Artificial Sequence
  Synthetic Construct
gacctgatagcaaaactgctccta

SEQ ID NO: 40325 - DNA, 22 bp, Artificial Sequence
  Synthetic Construct
cccatacgtgcaccaagcatac

SEQ ID NO: 40326 - DNA, 21 bp, Artificial Sequence
  Synthetic Construct
cagggaaatcccagcttccat

SEQ ID NO: 40327 - DNA, 23 bp, Artificial Sequence
  Synthetic Construct
gaaaccgatagctacccttgctt

SEQ ID NO: 40328 - DNA, 19 bp, Artificial Sequence
  Synthetic Construct
accctcggctcctgctcta

SEQ ID NO: 40329 - DNA, 19 bp, Artificial Sequence
  Synthetic Construct
cccctggactcctgctgat

SEQ ID NO: 40330 - DNA, 21 bp, Artificial Sequence
  Synthetic Construct
ccctgcaaatactgcccttga

SEQ ID NO: 40331 - DNA, 21 bp, Artificial Sequence
  Synthetic Construct
gggttgccagtggctgagaat

SEQ ID NO: 40332 - DNA, 20 bp, Artificial Sequence
  Synthetic Construct
tgcagtgagggttcctgttg

SEQ ID NO: 40333 - DNA, 21 bp, Artificial Sequence
  Synthetic Construct
tgcctgcttgactgtggtttc

SEQ ID NO: 40334 - DNA, 24 bp, Artificial Sequence
  Synthetic Construct
caggtctctccttctggctaaatc

SEQ ID NO: 40335 - DNA, 25 bp, Artificial Sequence
  Synthetic Construct
ctgcatcataaccatgtgaggtaga

SEQ ID NO: 40336 - DNA, 20 bp, Artificial Sequence
  Synthetic Construct
cggcagccttcattctcaca

SEQ ID NO: 40337 - DNA, 24 bp, Artificial Sequence
  Synthetic Construct
cagcttgagcttgagatcctttct

SEQ ID NO: 40338 - DNA, 23 bp, Artificial Sequence
  Synthetic Construct
ggggaaactgcaccttgtatttg

SEQ ID NO: 40339 - DNA, 20 bp, Artificial Sequence
  Synthetic Construct
tgctgctgatgggtccctaa

SEQ ID NO: 40340 - DNA, 24 bp, Artificial Sequence
  Synthetic Construct
acttcaaagcagccattgtctgta

SEQ ID NO: 40341 - DNA, 26 bp, Artificial Sequence
  Synthetic Construct
ctgtttcatggttgcaagctcatttg

SEQ ID NO: 40342 - DNA, 22 bp, Artificial Sequence
  Synthetic Construct
ggggtctccttcttgagtctga

SEQ ID NO: 40343 - DNA, 21 bp, Artificial Sequence
  Synthetic Construct
cctggagggatttcccacact

SEQ ID NO: 40344 - DNA, 24 bp, Artificial Sequence
  Synthetic Construct
gtactcatccacctcgaagcttta

SEQ ID NO: 40345 - DNA, 22 bp, Artificial Sequence
  Synthetic Construct
gcctgtgatggctttctgttga

SEQ ID NO: 40346 - DNA, 24 bp, Artificial Sequence
  Synthetic Construct
gcagttcagtgctccagcctagat

SEQ ID NO: 40347 - DNA, 22 bp, Artificial Sequence
  Synthetic Construct
gcctcaacagacagccagctaa

SEQ ID NO: 40348 - DNA, 22 bp, Artificial Sequence
  Synthetic Construct
aatggttgagtccatccacgaa

SEQ ID NO: 40349 - DNA, 22 bp, Artificial Sequence
  Synthetic Construct
actgaattccaccacccagaca

SEQ ID NO: 40350 - DNA, 22 bp, Artificial Sequence
  Synthetic Construct
gacatgaggaccaccgtctatg

SEQ ID NO: 40351 - DNA, 22 bp, Artificial Sequence
  Synthetic Construct
tggagaaatggaggcagaggtt

SEQ ID NO: 40352 - DNA, 25 bp, Artificial Sequence
  Synthetic Construct
ggaactggatgctgtcacctctttc

SEQ ID NO: 40353 - DNA, 24 bp, Artificial Sequence
  Synthetic Construct
gctcacactactgaggcgagatag

SEQ ID NO: 40354 - DNA, 22 bp, Artificial Sequence
  Synthetic Construct
ctgctggtggatgtggtactga

SEQ ID NO: 40355 - DNA, 22 bp, Artificial Sequence
  Synthetic Construct
gggaagggcttatctgccttag

SEQ ID NO: 40356 - DNA, 20 bp, Artificial Sequence
  Synthetic Construct
aacccaaccaaagccgtgta

SEQ ID NO: 40357 - DNA, 24 bp, Artificial Sequence
  Synthetic Construct
ccctgtctgtaggaccaggtttct

SEQ ID NO: 40358 - DNA, 28 bp, Artificial Sequence
  Synthetic Construct
ggacagcaaaatacgccaatatcacaca

SEQ ID NO: 40359 - DNA, 26 bp, Artificial Sequence
  Synthetic Construct
accccagtaaagatgtaatgctcaag

SEQ ID NO: 40360 - DNA, 24 bp, Artificial Sequence
  Synthetic Construct
tggtaaagatcaccagaagcagtt

SEQ ID NO: 40361 - DNA, 18 bp, Artificial Sequence
  Synthetic Construct
aaggcctgggcagtcaca

SEQ ID NO: 40362 - DNA, 18 bp, Artificial Sequence
  Synthetic Construct
tggcagctggctgcaaat

SEQ ID NO: 40363 - DNA, 22 bp, Artificial Sequence
  Synthetic Construct
gggctcctcccaaagtcatcaa

SEQ ID NO: 40364 - DNA, 25 bp, Artificial Sequence
  Synthetic Construct
gcattttactaacccctacctgcat

SEQ ID NO: 40365 - DNA, 24 bp, Artificial Sequence
  Synthetic Construct
ggccccgttggtgatatgatgaga

SEQ ID NO: 40366 - DNA, 27 bp, Artificial Sequence
  Synthetic Construct
ggcctagaataacggttttaccctgaa

SEQ ID NO: 40367 - DNA, 21 bp, Artificial Sequence
  Synthetic Construct
gtgagtcactggccaatctga

SEQ ID NO: 40368 - DNA, 23 bp, Artificial Sequence
  Synthetic Construct
cacgagaaagccttgacaaacaa

SEQ ID NO: 40369 - DNA, 22 bp, Artificial Sequence
  Synthetic Construct
ggcctgacaatgtttgcctctt

SEQ ID NO: 40370 - DNA, 24 bp, Artificial Sequence
  Synthetic Construct
gcaagttgttcagagggtctggta

SEQ ID NO: 40371 - DNA, 22 bp, Artificial Sequence
  Synthetic Construct
caccgggatcattgtcctgtct

SEQ ID NO: 40372 - DNA, 26 bp, Artificial Sequence
  Synthetic Construct
gagaaggaatgactgtgggagaatag

SEQ ID NO: 40373 - DNA, 21 bp, Artificial Sequence
  Synthetic Construct
tgtgtctcctcacccatgcta

SEQ ID NO: 40374 - DNA, 20 bp, Artificial Sequence
  Synthetic Construct
ggtgtggcagcagaaacagt

SEQ ID NO: 40375 - DNA, 21 bp, Artificial Sequence
  Synthetic Construct
gctgtcaacacctgtgcatct

SEQ ID NO: 40376 - DNA, 24 bp, Artificial Sequence
  Synthetic Construct
tgaaacttcacagcctgcttacat

SEQ ID NO: 40377 - DNA, 26 bp, Artificial Sequence
  Synthetic Construct
gtggatgatgtcatttctgagtctct

SEQ ID NO: 40378 - DNA, 21 bp, Artificial Sequence
  Synthetic Construct
gggcctctcccttcactcatt

SEQ ID NO: 40379 - DNA, 21 bp, Artificial Sequence
  Synthetic Construct
ggcttacactgcatggcaaag

SEQ ID NO: 40380 - DNA, 19 bp, Artificial Sequence
  Synthetic Construct
tgggcttggcagggtgtag

SEQ ID NO: 40381 - DNA, 20 bp, Artificial Sequence
  Synthetic Construct
agctggctggctgttgatga

SEQ ID NO: 40382 - DNA, 20 bp, Artificial Sequence
  Synthetic Construct
acccacagggtgtcagactt

SEQ ID NO: 40383 - DNA, 22 bp, Artificial Sequence
  Synthetic Construct
tcggggccctagatagtgaaag

SEQ ID NO: 40384 - DNA, 25 bp, Artificial Sequence
  Synthetic Construct
gctgtcccagtgccatattgaccat

SEQ ID NO: 40385 - DNA, 21 bp, Artificial Sequence
  Synthetic Construct
tggaaaccccacccaccttca

SEQ ID NO: 40386 - DNA, 23 bp, Artificial Sequence
  Synthetic Construct
ccaaaggagtaatggtggtggaa

SEQ ID NO: 40387 - DNA, 18 bp, Artificial Sequence
  Synthetic Construct
tggccagctcagggttga

SEQ ID NO: 40388 - DNA, 22 bp, Artificial Sequence
  Synthetic Construct
ttgtgaggacagcagtctgttt

SEQ ID NO: 40389 - DNA, 20 bp, Artificial Sequence
  Synthetic Construct
tggggctttccgtagactgt

SEQ ID NO: 40390 - DNA, 20 bp, Artificial Sequence
  Synthetic Construct
agcaagggccaaagcacgaa

SEQ ID NO: 40391 - DNA, 25 bp, Artificial Sequence
  Synthetic Construct
cagccacacttacttccatgctaca

SEQ ID NO: 40392 - DNA, 19 bp, Artificial Sequence
  Synthetic Construct
ggggagggaggacacagaa

SEQ ID NO: 40393 - DNA, 27 bp, Artificial Sequence
  Synthetic Construct
cacctggaaattgacagcttagacaga

SEQ ID NO: 40394 - DNA, 22 bp, Artificial Sequence
  Synthetic Construct
ggaagagagcacctggagtttc

SEQ ID NO: 40395 - DNA, 20 bp, Artificial Sequence
  Synthetic Construct
taagtcctcctgccgtggaa

SEQ ID NO: 40396 - DNA, 20 bp, Artificial Sequence
  Synthetic Construct
agggtgctggcagagacaga

SEQ ID NO: 40397 - DNA, 25 bp, Artificial Sequence
  Synthetic Construct
cactctttcttgggatgcaactatc

SEQ ID NO: 40398 - DNA, 21 bp, Artificial Sequence
  Synthetic Construct
tgggtggaagtgtgtggatga

SEQ ID NO: 40399 - DNA, 19 bp, Artificial Sequence
  Synthetic Construct
aaggggcaggacagcatct

SEQ ID NO: 40400 - DNA, 25 bp, Artificial Sequence
  Synthetic Construct
ggaaggaagcatctccagacctctt

SEQ ID NO: 40401 - DNA, 26 bp, Artificial Sequence
  Synthetic Construct
ccatggaggattcatgttccagtaga

SEQ ID NO: 40402 - DNA, 24 bp, Artificial Sequence
  Synthetic Construct
cctgcttaaccctgggccatttac

SEQ ID NO: 40403 - DNA, 23 bp, Artificial Sequence
  Synthetic Construct
aaggtcaactttcacctccatgt

SEQ ID NO: 40404 - DNA, 25 bp, Artificial Sequence
  Synthetic Construct
gtgaggaagaaggaagagcgtatgt

SEQ ID NO: 40405 - DNA, 23 bp, Artificial Sequence
  Synthetic Construct
ggaagggaagcctttcccagaat

SEQ ID NO: 40406 - DNA, 21 bp, Artificial Sequence
  Synthetic Construct
ggctggctgtggtttcagagt

SEQ ID NO: 40407 - DNA, 22 bp, Artificial Sequence
  Synthetic Construct
tgctcaccctctcactccaatg

SEQ ID NO: 40408 - DNA, 21 bp, Artificial Sequence
  Synthetic Construct
cccaacccctgtgagacttca

SEQ ID NO: 40409 - DNA, 20 bp, Artificial Sequence
  Synthetic Construct
aggttcaggcaaggggaagt

SEQ ID NO: 40410 - DNA, 24 bp, Artificial Sequence
  Synthetic Construct
ttctgtcagcagaaggggattaag

SEQ ID NO: 40411 - DNA, 27 bp, Artificial Sequence
  Synthetic Construct
cccaagtcttttccttctgggttcaag

SEQ ID NO: 40412 - DNA, 26 bp, Artificial Sequence
  Synthetic Construct
gtatttcagttcctagtgccttcgta

SEQ ID NO: 40413 - DNA, 26 bp, Artificial Sequence
  Synthetic Construct
gctccatctctgtagactttggctta

SEQ ID NO: 40414 - DNA, 22 bp, Artificial Sequence
  Synthetic Construct
ctttgctggtcctctggttttg

SEQ ID NO: 40415 - DNA, 20 bp, Artificial Sequence
  Synthetic Construct
cggggcagtgtacaggagta

SEQ ID NO: 40416 - DNA, 19 bp, Artificial Sequence
  Synthetic Construct
tcctctgccctccctgcta

SEQ ID NO: 40417 - DNA, 21 bp, Artificial Sequence
  Synthetic Construct
tccctgcactgctgctctcta

SEQ ID NO: 40418 - DNA, 24 bp, Artificial Sequence
  Synthetic Construct
aagcaagagtggctctttcaattc

SEQ ID NO: 40419 - DNA, 23 bp, Artificial Sequence
  Synthetic Construct
ccactctcgagaactacggtttc

SEQ ID NO: 40420 - DNA, 21 bp, Artificial Sequence
  Synthetic Construct
tgcccagatactcggcaaatg

SEQ ID NO: 40421 - DNA, 24 bp, Artificial Sequence
  Synthetic Construct
ggttggctgaaaaacctggttcaa

SEQ ID NO: 40422 - DNA, 20 bp, Artificial Sequence
  Synthetic Construct
tggcttagggcccagaggat

SEQ ID NO: 40423 - DNA, 25 bp, Artificial Sequence
  Synthetic Construct
gcaaaagctgtcaactccaccatag

SEQ ID NO: 40424 - DNA, 21 bp, Artificial Sequence
  Synthetic Construct
tgccactgatggccactgttc

SEQ ID NO: 40425 - DNA, 23 bp, Artificial Sequence
  Synthetic Construct
cccatctccacttttggagtctt

SEQ ID NO: 40426 - DNA, 20 bp, Artificial Sequence
  Synthetic Construct
gctgcagtaagcaccagtga

SEQ ID NO: 40427 - DNA, 26 bp, Artificial Sequence
  Synthetic Construct
acgagaacatccagagatacttgaga

SEQ ID NO: 40428 - DNA, 20 bp, Artificial Sequence
  Synthetic Construct
gggccttgatttgccagagt

SEQ ID NO: 40429 - DNA, 21 bp, Artificial Sequence
  Synthetic Construct
ttgccggaatgaggaggattg

SEQ ID NO: 40430 - DNA, 24 bp, Artificial Sequence
  Synthetic Construct
ctctagcctttcagtccgtctttg

SEQ ID NO: 40431 - DNA, 25 bp, Artificial Sequence
  Synthetic Construct
gacacacagataatgaaggcacaga

SEQ ID NO: 40432 - DNA, 22 bp, Artificial Sequence
  Synthetic Construct
ccacgtggcgtatcttctgcat

SEQ ID NO: 40433 - DNA, 20 bp, Artificial Sequence
  Synthetic Construct
cctcagctgtcagccagcaa

SEQ ID NO: 40434 - DNA, 23 bp, Artificial Sequence
  Synthetic Construct
gcactaacgtagtaggccagaac

SEQ ID NO: 40435 - DNA, 26 bp, Artificial Sequence
  Synthetic Construct
acactgatccttattgatggggaaac

SEQ ID NO: 40436 - DNA, 18 bp, Artificial Sequence
  Synthetic Construct
acagcacggccaccattg

SEQ ID NO: 40437 - DNA, 20 bp, Artificial Sequence
  Synthetic Construct
aagcatggcccgtgggtgaa

SEQ ID NO: 40438 - DNA, 20 bp, Artificial Sequence
  Synthetic Construct
tggcctggcttcagggcata

SEQ ID NO: 40439 - DNA, 23 bp, Artificial Sequence
  Synthetic Construct
acaaaagaatggaggcccacaga

SEQ ID NO: 40440 - DNA, 28 bp, Artificial Sequence
  Synthetic Construct
gagctaagtgaagtatgagtgggattca

SEQ ID NO: 40441 - DNA, 24 bp, Artificial Sequence
  Synthetic Construct
ggcttagagcactcctcagacaga

SEQ ID NO: 40442 - DNA, 21 bp, Artificial Sequence
  Synthetic Construct
gccccttggccacatcttagt

SEQ ID NO: 40443 - DNA, 20 bp, Artificial Sequence
  Synthetic Construct
accatatgccgggtgctact

SEQ ID NO: 40444 - DNA, 24 bp, Artificial Sequence
  Synthetic Construct
ttttccttactgatcctgccacat

SEQ ID NO: 40445 - DNA, 23 bp, Artificial Sequence
  Synthetic Construct
ggccagcacagtgattgtcctaa

SEQ ID NO: 40446 - DNA, 26 bp, Artificial Sequence
  Synthetic Construct
ttgaatgggattctctaggaggagat

SEQ ID NO: 40447 - DNA, 22 bp, Artificial Sequence
  Synthetic Construct
gctcaattcggaggagcaggtt

SEQ ID NO: 40448 - DNA, 20 bp, Artificial Sequence
  Synthetic Construct
tggctgtggaatgcagttga

SEQ ID NO: 40449 - DNA, 21 bp, Artificial Sequence
  Synthetic Construct
tggggagtgaagatgctgaac

SEQ ID NO: 40450 - DNA, 23 bp, Artificial Sequence
  Synthetic Construct
gcccatggcaatcttggctaatg

SEQ ID NO: 40451 - DNA, 27 bp, Artificial Sequence
  Synthetic Construct
cagctctgaatttggcccttctattct

SEQ ID NO: 40452 - DNA, 24 bp, Artificial Sequence
  Synthetic Construct
ggagcaaacacgtggagaaacaac

SEQ ID NO: 40453 - DNA, 23 bp, Artificial Sequence
  Synthetic Construct
ggcttgatcacagtgctgacttc

SEQ ID NO: 40454 - DNA, 18 bp, Artificial Sequence
  Synthetic Construct
tcagggccacctggatgt

SEQ ID NO: 40455 - DNA, 23 bp, Artificial Sequence
  Synthetic Construct
cgaagttatggctgggacaaatc

SEQ ID NO: 40456 - DNA, 23 bp, Artificial Sequence
  Synthetic Construct
tgcagcacaaagtactgggattt

SEQ ID NO: 40457 - DNA, 20 bp, Artificial Sequence
  Synthetic Construct
ggggtcctggggaggtatca

SEQ ID NO: 40458 - DNA, 25 bp, Artificial Sequence
  Synthetic Construct
gccctccatgaaactcaatgacact

SEQ ID NO: 40459 - DNA, 29 bp, Artificial Sequence
  Synthetic Construct
gccctttgaaaactgatcttgtactgcta

SEQ ID NO: 40460 - DNA, 24 bp, Artificial Sequence
  Synthetic Construct
ggctgcttccctagaaagacaaca

SEQ ID NO: 40461 - DNA, 22 bp, Artificial Sequence
  Synthetic Construct
tggacacccgtcaaggaggaaa

SEQ ID NO: 40462 - DNA, 18 bp, Artificial Sequence
  Synthetic Construct
acgctgctgtgcctcaag

SEQ ID NO: 40463 - DNA, 22 bp, Artificial Sequence
  Synthetic Construct
tggccaacagactgctgtcaac

SEQ ID NO: 40464 - DNA, 22 bp, Artificial Sequence
  Synthetic Construct
ggacagcaaaggctgcttgact

SEQ ID NO: 40465 - DNA, 20 bp, Artificial Sequence
  Synthetic Construct
gtgggatgcccaccttgttt

SEQ ID NO: 40466 - DNA, 20 bp, Artificial Sequence
  Synthetic Construct
ccccatcagacaggcacctt

SEQ ID NO: 40467 - DNA, 24 bp, Artificial Sequence
  Synthetic Construct
gcaagacacctgagatgctgatac

SEQ ID NO: 40468 - DNA, 20 bp, Artificial Sequence
  Synthetic Construct
acagcatgggagccagtcat

SEQ ID NO: 40469 - DNA, 22 bp, Artificial Sequence
  Synthetic Construct
cctgcagacagtgccttacctt

SEQ ID NO: 40470 - DNA, 25 bp, Artificial Sequence
  Synthetic Construct
ggcatggtagactgagactggattg

SEQ ID NO: 40471 - DNA, 20 bp, Artificial Sequence
  Synthetic Construct
ccttctgccccagcttcatc

SEQ ID NO: 40472 - DNA, 20 bp, Artificial Sequence
  Synthetic Construct
gcgtgataggaagcgtgcat

SEQ ID NO: 40473 - DNA, 23 bp, Artificial Sequence
  Synthetic Construct
agagagctttcacctcctggtta

SEQ ID NO: 40474 - DNA, 27 bp, Artificial Sequence
  Synthetic Construct
gcttccgagaggttactgatacactga

SEQ ID NO: 40475 - DNA, 26 bp, Artificial Sequence
  Synthetic Construct
ccaattgatccagtgagtgtggttag

SEQ ID NO: 40476 - DNA, 19 bp, Artificial Sequence
  Synthetic Construct
cccaccatgtctggccatt

SEQ ID NO: 40477 - DNA, 20 bp, Artificial Sequence
  Synthetic Construct
aggttcacgcagccttgttg

SEQ ID NO: 40478 - DNA, 19 bp, Artificial Sequence
  Synthetic Construct
gggctccaaagtcgcgaaa

SEQ ID NO: 40479 - DNA, 23 bp, Artificial Sequence
  Synthetic Construct
atccaatgaaactggagcaggaa

SEQ ID NO: 40480 - DNA, 21 bp, Artificial Sequence
  Synthetic Construct
cggtgttcctggacatgtgtt

SEQ ID NO: 40481 - DNA, 20 bp, Artificial Sequence
  Synthetic Construct
gtgggcaacaccgagagatg

SEQ ID NO: 40482 - DNA, 19 bp, Artificial Sequence
  Synthetic Construct
cccacagcaccacgagctt

SEQ ID NO: 40483 - DNA, 20 bp, Artificial Sequence
  Synthetic Construct
caaccgcttgcgatgcttct

SEQ ID NO: 40484 - DNA, 22 bp, Artificial Sequence
  Synthetic Construct
ccttttccagcctctgaaggaa

SEQ ID NO: 40485 - DNA, 22 bp, Artificial Sequence
  Synthetic Construct
tccacaggaaacctcccctgat

SEQ ID NO: 40486 - DNA, 22 bp, Artificial Sequence
  Synthetic Construct
ctttagcagcagcagtggaaga

SEQ ID NO: 40487 - DNA, 23 bp, Artificial Sequence
  Synthetic Construct
gaaggaagagccaacaggattgt

SEQ ID NO: 40488 - DNA, 25 bp, Artificial Sequence
  Synthetic Construct
aatacccttccaccctgaattttct

SEQ ID NO: 40489 - DNA, 23 bp, Artificial Sequence
  Synthetic Construct
cggagataccagctcactacgaa

SEQ ID NO: 40490 - DNA, 25 bp, Artificial Sequence
  Synthetic Construct
gagagatgaccaggaacacatcttg

SEQ ID NO: 40491 - DNA, 20 bp, Artificial Sequence
  Synthetic Construct
ggatgccctgcaactagcaa

SEQ ID NO: 40492 - DNA, 22 bp, Artificial Sequence
  Synthetic Construct
ccccaaaccctctctgagattc

SEQ ID NO: 40493 - DNA, 20 bp, Artificial Sequence
  Synthetic Construct
tgcagggtgcaacagactga

SEQ ID NO: 40494 - DNA, 21 bp, Artificial Sequence
  Synthetic Construct
ctgtgaagcagtgggtgagat

SEQ ID NO: 40495 - DNA, 23 bp, Artificial Sequence
  Synthetic Construct
catgtttggtgtgcaaaggatga

SEQ ID NO: 40496 - DNA, 21 bp, Artificial Sequence
  Synthetic Construct
agttgtgttgggcctttccaa

SEQ ID NO: 40497 - DNA, 22 bp, Artificial Sequence
  Synthetic Construct
tgacctgtctggtcccatgtag

SEQ ID NO: 40498 - DNA, 20 bp, Artificial Sequence
  Synthetic Construct
ggaggtcagagacgcagaca

SEQ ID NO: 40499 - DNA, 23 bp, Artificial Sequence
  Synthetic Construct
ggatgcacaagtttcaaggaaca

SEQ ID NO: 40500 - DNA, 25 bp, Artificial Sequence
  Synthetic Construct
cacacttccttcaatgctgggatct

SEQ ID NO: 40501 - DNA, 25 bp, Artificial Sequence
  Synthetic Construct
ggcaaatagacaaccgttcggtcaa

SEQ ID NO: 40502 - DNA, 20 bp, Artificial Sequence
  Synthetic Construct
tcaggctactctgggtggtt

SEQ ID NO: 40503 - DNA, 26 bp, Artificial Sequence
  Synthetic Construct
gtgtttgtccttctgtctgccaatag

SEQ ID NO: 40504 - DNA, 24 bp, Artificial Sequence
  Synthetic Construct
ggcatccaagaagtttcccaggtt

SEQ ID NO: 40505 - DNA, 22 bp, Artificial Sequence
  Synthetic Construct
ctccaacctctccctagtgctt

SEQ ID NO: 40506 - DNA, 25 bp, Artificial Sequence
  Synthetic Construct
cccacttggttcggatttggagtag

SEQ ID NO: 40507 - DNA, 22 bp, Artificial Sequence
  Synthetic Construct
gtgttgaaccccatcgggagaa

SEQ ID NO: 40508 - DNA, 19 bp, Artificial Sequence
  Synthetic Construct
agcgctaggctctggaaga

SEQ ID NO: 40509 - DNA, 23 bp, Artificial Sequence
  Synthetic Construct
tcagttggactcacaccgtatct

SEQ ID NO: 40510 - DNA, 24 bp, Artificial Sequence
  Synthetic Construct
gggcacattccatcaacacctttg

SEQ ID NO: 40511 - DNA, 24 bp, Artificial Sequence
  Synthetic Construct
cagtgttctctgttcctgcagatt

SEQ ID NO: 40512 - DNA, 27 bp, Artificial Sequence
  Synthetic Construct
ctcatcctaatactgacctgtggttca

SEQ ID NO: 40513 - DNA, 25 bp, Artificial Sequence
  Synthetic Construct
cccatagccagtcaaagatcaggtt

SEQ ID NO: 40514 - DNA, 23 bp, Artificial Sequence
  Synthetic Construct
ctgaggagagaggctaactgaca

SEQ ID NO: 40515 - DNA, 22 bp, Artificial Sequence
  Synthetic Construct
gggaaaagcccagtgtctgatg

SEQ ID NO: 40516 - DNA, 21 bp, Artificial Sequence
  Synthetic Construct
tggcatttgcaaggggaacaa

SEQ ID NO: 40517 - DNA, 21 bp, Artificial Sequence
  Synthetic Construct
agggaggaggcaaggacacaa

SEQ ID NO: 40518 - DNA, 19 bp, Artificial Sequence
  Synthetic Construct
tgtggggcaccatgggttt

SEQ ID NO: 40519 - DNA, 23 bp, Artificial Sequence
  Synthetic Construct
ccacccacaacaagcctcctatg

SEQ ID NO: 40520 - DNA, 20 bp, Artificial Sequence
  Synthetic Construct
aaggaaggggcagaggttca

SEQ ID NO: 40521 - DNA, 23 bp, Artificial Sequence
  Synthetic Construct
ccattgagcccaggtcatcatgt

SEQ ID NO: 40522 - DNA, 20 bp, Artificial Sequence
  Synthetic Construct
ggggtgaaaggcacgagtaa

SEQ ID NO: 40523 - DNA, 19 bp, Artificial Sequence
  Synthetic Construct
gcagtgacatggcctgcat

SEQ ID NO: 40524 - DNA, 24 bp, Artificial Sequence
  Synthetic Construct
ccgagactcatccagtctgtcctt

SEQ ID NO: 40525 - DNA, 22 bp, Artificial Sequence
  Synthetic Construct
agctcttctgcatccgccttag

SEQ ID NO: 40526 - DNA, 27 bp, Artificial Sequence
  Synthetic Construct
cctactcgttaactcacattgacttct

SEQ ID NO: 40527 - DNA, 20 bp, Artificial Sequence
  Synthetic Construct
acctgctgtgtacccctgaa

SEQ ID NO: 40528 - DNA, 20 bp, Artificial Sequence
  Synthetic Construct
aggccacttgccatcccatt

SEQ ID NO: 40529 - DNA, 27 bp, Artificial Sequence
  Synthetic Construct
cggcatcactaccatcttttctagagt

SEQ ID NO: 40530 - DNA, 20 bp, Artificial Sequence
  Synthetic Construct
gccaccctggcctctgattc

SEQ ID NO: 40531 - DNA, 25 bp, Artificial Sequence
  Synthetic Construct
gtggcagaaaagatgggttttgctt

SEQ ID NO: 40532 - DNA, 20 bp, Artificial Sequence
  Synthetic Construct
gccctttccaggcacccatt

SEQ ID NO: 40533 - DNA, 25 bp, Artificial Sequence
  Synthetic Construct
cctcccaagtcaacgaatgggtatc

SEQ ID NO: 40534 - DNA, 26 bp, Artificial Sequence
  Synthetic Construct
gtgacaagttcaaatgactgcgttga

SEQ ID NO: 40535 - DNA, 20 bp, Artificial Sequence
  Synthetic Construct
tcctgagcctgtgtccaagt

SEQ ID NO: 40536 - DNA, 19 bp, Artificial Sequence
  Synthetic Construct
aggccacgctgggaacctt

SEQ ID NO: 40537 - DNA, 22 bp, Artificial Sequence
  Synthetic Construct
cttcgtccttgcttcctgtttc

SEQ ID NO: 40538 - DNA, 22 bp, Artificial Sequence
  Synthetic Construct
gctgtcacctttggctggaaag

SEQ ID NO: 40539 - DNA, 24 bp, Artificial Sequence
  Synthetic Construct
caagacagatcctgagtggctaac

SEQ ID NO: 40540 - DNA, 20 bp, Artificial Sequence
  Synthetic Construct
cctcactgcagcctcaaact

SEQ ID NO: 40541 - DNA, 20 bp, Artificial Sequence
  Synthetic Construct
tgggtcccctctggcagtgt

SEQ ID NO: 40542 - DNA, 21 bp, Artificial Sequence
  Synthetic Construct
aacgcttcagtggcttacact

SEQ ID NO: 40543 - DNA, 23 bp, Artificial Sequence
  Synthetic Construct
tcccctccagagttccctctttg

SEQ ID NO: 40544 - DNA, 22 bp, Artificial Sequence
  Synthetic Construct
gagctgaaaggcacaggacttg

SEQ ID NO: 40545 - DNA, 25 bp, Artificial Sequence
  Synthetic Construct
aggaaatcaattgcttctcgtgact

SEQ ID NO: 40546 - DNA, 23 bp, Artificial Sequence
  Synthetic Construct
tctgacttcccttgtctccaagt

SEQ ID NO: 40547 - DNA, 22 bp, Artificial Sequence
  Synthetic Construct
ccaccacacgtggcctaaactt

SEQ ID NO: 40548 - DNA, 22 bp, Artificial Sequence
  Synthetic Construct
cagttcaagcccagaggtgatg

SEQ ID NO: 40549 - DNA, 21 bp, Artificial Sequence
  Synthetic Construct
tggccctgagcttgtcacttg

SEQ ID NO: 40550 - DNA, 22 bp, Artificial Sequence
  Synthetic Construct
tgccttcctgtgtgggacagta

SEQ ID NO: 40551 - DNA, 20 bp, Artificial Sequence
  Synthetic Construct
gctgcctgccttcaggtact

SEQ ID NO: 40552 - DNA, 25 bp, Artificial Sequence
  Synthetic Construct
ttttggatgtgaagggactactgaa

SEQ ID NO: 40553 - DNA, 23 bp, Artificial Sequence
  Synthetic Construct
gtctggcttgataggctccatct

SEQ ID NO: 40554 - DNA, 20 bp, Artificial Sequence
  Synthetic Construct
tggggtgtgcatcagtgttc

SEQ ID NO: 40555 - DNA, 26 bp, Artificial Sequence
  Synthetic Construct
ggcagattgatggagcaagtctccta

SEQ ID NO: 40556 - DNA, 21 bp, Artificial Sequence
  Synthetic Construct
ggtgggcagcaggtgaaatct

SEQ ID NO: 40557 - DNA, 23 bp, Artificial Sequence
  Synthetic Construct
gcaagctggagacgtaagagcta

SEQ ID NO: 40558 - DNA, 26 bp, Artificial Sequence
  Synthetic Construct
cctaagacatgtaacgctttctgtga

SEQ ID NO: 40559 - DNA, 25 bp, Artificial Sequence
  Synthetic Construct
cagggaaagcacacaatatgccatt

SEQ ID NO: 40560 - DNA, 24 bp, Artificial Sequence
  Synthetic Construct
gtgcacagaatgggaaatggtgtt

SEQ ID NO: 40561 - DNA, 21 bp, Artificial Sequence
  Synthetic Construct
tcctacacgtgggcctgacat

SEQ ID NO: 40562 - DNA, 24 bp, Artificial Sequence
  Synthetic Construct
aggagatagaggcaaagacctgaa

SEQ ID NO: 40563 - DNA, 24 bp, Artificial Sequence
  Synthetic Construct
cctgtactcagaaacgcagctaca

SEQ ID NO: 40564 - DNA, 18 bp, Artificial Sequence
  Synthetic Construct
ggtggcaaagccgcacat

SEQ ID NO: 40565 - DNA, 23 bp, Artificial Sequence
  Synthetic Construct
gggctatggagtcaggaaactgt

SEQ ID NO: 40566 - DNA, 27 bp, Artificial Sequence
  Synthetic Construct
ggaggaaaaaggcttaggaagctgaag

SEQ ID NO: 40567 - DNA, 20 bp, Artificial Sequence
  Synthetic Construct
tcctgtggttgcctccagat

SEQ ID NO: 40568 - DNA, 20 bp, Artificial Sequence
  Synthetic Construct
tgccgattgcagacccacaa

SEQ ID NO: 40569 - DNA, 22 bp, Artificial Sequence
  Synthetic Construct
gccttccaagtgagaagcaaag

SEQ ID NO: 40570 - DNA, 27 bp, Artificial Sequence
  Synthetic Construct
acctcactatgacacactggttaaaag

SEQ ID NO: 40571 - DNA, 24 bp, Artificial Sequence
  Synthetic Construct
gaatgttctgccatcttgggaaag

SEQ ID NO: 40572 - DNA, 30 bp, Artificial Sequence
  Synthetic Construct
gggagacggaagttctcccttctataatac

SEQ ID NO: 40573 - DNA, 24 bp, Artificial Sequence
  Synthetic Construct
tcttgaatgcattgccgtgtttac

SEQ ID NO: 40574 - DNA, 22 bp, Artificial Sequence
  Synthetic Construct
ccagtgcagggtgccatttaca

SEQ ID NO: 40575 - DNA, 20 bp, Artificial Sequence
  Synthetic Construct
cagagtccgagaggcacaga

SEQ ID NO: 40576 - DNA, 29 bp, Artificial Sequence
  Synthetic Construct
ccatacctcctttactggatagtgagttc

SEQ ID NO: 40577 - DNA, 22 bp, Artificial Sequence
  Synthetic Construct
tgccttgacctccccattctga

SEQ ID NO: 40578 - DNA, 22 bp, Artificial Sequence
  Synthetic Construct
ctgcagaaatgcccaggagttg

SEQ ID NO: 40579 - DNA, 29 bp, Artificial Sequence
  Synthetic Construct
gggttaggtgactctaggagtatagtaag

SEQ ID NO: 40580 - DNA, 25 bp, Artificial Sequence
  Synthetic Construct
gcccctcaatttgctatgagcttgt

SEQ ID NO: 40581 - DNA, 20 bp, Artificial Sequence
  Synthetic Construct
tggcaacgacgggtagtaag

SEQ ID NO: 40582 - DNA, 23 bp, Artificial Sequence
  Synthetic Construct
actgtcttgtgaccaggagagta

SEQ ID NO: 40583 - DNA, 22 bp, Artificial Sequence
  Synthetic Construct
cgcattcaggggcacttccaaa

SEQ ID NO: 40584 - DNA, 24 bp, Artificial Sequence
  Synthetic Construct
ttctctgacaaagactgggaaaca

SEQ ID NO: 40585 - DNA, 22 bp, Artificial Sequence
  Synthetic Construct
gttccttgcagcagtgacaaga

SEQ ID NO: 40586 - DNA, 20 bp, Artificial Sequence
  Synthetic Construct
tggttggcagcacacagtga

SEQ ID NO: 40587 - DNA, 24 bp, Artificial Sequence
  Synthetic Construct
ggaggcatctcacttcctcctgaa

SEQ ID NO: 40588 - DNA, 28 bp, Artificial Sequence
  Synthetic Construct
caccctacaactagatggaaccctaatc

SEQ ID NO: 40589 - DNA, 29 bp, Artificial Sequence
  Synthetic Construct
gcatccctattactgtcttagctgtcaga

SEQ ID NO: 40590 - DNA, 21 bp, Artificial Sequence
  Synthetic Construct
gagagtttgggcactggtgat

SEQ ID NO: 40591 - DNA, 21 bp, Artificial Sequence
  Synthetic Construct
gcctccagggtgctactctca

SEQ ID NO: 40592 - DNA, 22 bp, Artificial Sequence
  Synthetic Construct
tcatctctcccctctcaacgaa

SEQ ID NO: 40593 - DNA, 27 bp, Artificial Sequence
  Synthetic Construct
actttcacagtcaccatttctggatag

SEQ ID NO: 40594 - DNA, 26 bp, Artificial Sequence
  Synthetic Construct
gctgagctttcgttttgacccagaag

SEQ ID NO: 40595 - DNA, 24 bp, Artificial Sequence
  Synthetic Construct
agccagattgcagtgaattgaaga

SEQ ID NO: 40596 - DNA, 20 bp, Artificial Sequence
  Synthetic Construct
gtagtggtggcagtggcaaa

SEQ ID NO: 40597 - DNA, 21 bp, Artificial Sequence
  Synthetic Construct
ctgcctcattccaaggtctgt

SEQ ID NO: 40598 - DNA, 25 bp, Artificial Sequence
  Synthetic Construct
gagggaagagagtagtccaggttat

SEQ ID NO: 40599 - DNA, 23 bp, Artificial Sequence
  Synthetic Construct
ggtttggacaccatgcttcactt

SEQ ID NO: 40600 - DNA, 23 bp, Artificial Sequence
  Synthetic Construct
gaactttgctggggagatgtctt

SEQ ID NO: 40601 - DNA, 20 bp, Artificial Sequence
  Synthetic Construct
cagccaagagcatggcagaa

SEQ ID NO: 40602 - DNA, 22 bp, Artificial Sequence
  Synthetic Construct
gggcatacggacctaagtggtt

SEQ ID NO: 40603 - DNA, 25 bp, Artificial Sequence
  Synthetic Construct
caggtttgggtttatcagcatgtag

SEQ ID NO: 40604 - DNA, 20 bp, Artificial Sequence
  Synthetic Construct
tgtcctgactcctgcccatt

SEQ ID NO: 40605 - DNA, 21 bp, Artificial Sequence
  Synthetic Construct
tgcctccagctagaccggaaa

SEQ ID NO: 40606 - DNA, 23 bp, Artificial Sequence
  Synthetic Construct
cccttctgaccattgctgctcaa

SEQ ID NO: 40607 - DNA, 22 bp, Artificial Sequence
  Synthetic Construct
caaggactttggctccctttct

SEQ ID NO: 40608 - DNA, 23 bp, Artificial Sequence
  Synthetic Construct
tcatcttctcaaggaggcctttc

SEQ ID NO: 40609 - DNA, 21 bp, Artificial Sequence
  Synthetic Construct
actgagcctggccctgttgta

SEQ ID NO: 40610 - DNA, 20 bp, Artificial Sequence
  Synthetic Construct
agagcccttggggctacact

SEQ ID NO: 40611 - DNA, 24 bp, Artificial Sequence
  Synthetic Construct
ggagaaccactgaagctttggaat

SEQ ID NO: 40612 - DNA, 21 bp, Artificial Sequence
  Synthetic Construct
gagcagcccttgttcatggat

SEQ ID NO: 40613 - DNA, 23 bp, Artificial Sequence
  Synthetic Construct
gaaagtgaccagatgcccatgat

SEQ ID NO: 40614 - DNA, 24 bp, Artificial Sequence
  Synthetic Construct
tggtgatgagtatgagaggctgat

SEQ ID NO: 40615 - DNA, 25 bp, Artificial Sequence
  Synthetic Construct
gtgtgtgtagagttccctcggttac

SEQ ID NO: 40616 - DNA, 21 bp, Artificial Sequence
  Synthetic Construct
tagcacccacacggggatcaa

SEQ ID NO: 40617 - DNA, 24 bp, Artificial Sequence
  Synthetic Construct
ctgaggacagacacccagagatag

SEQ ID NO: 40618 - DNA, 22 bp, Artificial Sequence
  Synthetic Construct
ccttgtcagggtttcgccaaca

SEQ ID NO: 40619 - DNA, 22 bp, Artificial Sequence
  Synthetic Construct
cgtgactgccctgaccatcttt

SEQ ID NO: 40620 - DNA, 19 bp, Artificial Sequence
  Synthetic Construct
ggcctgggtaccagtcctt

SEQ ID NO: 40621 - DNA, 21 bp, Artificial Sequence
  Synthetic Construct
attgccctgcttggggcaaga

SEQ ID NO: 40622 - DNA, 20 bp, Artificial Sequence
  Synthetic Construct
tcgtgccacagggtgactga

SEQ ID NO: 40623 - DNA, 22 bp, Artificial Sequence
  Synthetic Construct
aagcctgctttcctaggagttg

SEQ ID NO: 40624 - DNA, 23 bp, Artificial Sequence
  Synthetic Construct
agtgaagattgggcatggttaca

SEQ ID NO: 40625 - DNA, 18 bp, Artificial Sequence
  Synthetic Construct
tcacggtcctgcctcact

SEQ ID NO: 40626 - DNA, 22 bp, Artificial Sequence
  Synthetic Construct
tacccctcctgggaggaaccaa

SEQ ID NO: 40627 - DNA, 25 bp, Artificial Sequence
  Synthetic Construct
cagaaggaagctaccagtatcacaa

SEQ ID NO: 40628 - DNA, 26 bp, Artificial Sequence
  Synthetic Construct
ctgcagttggatcagaagtggtattc

SEQ ID NO: 40629 - DNA, 23 bp, Artificial Sequence
  Synthetic Construct
ggcctgattcatgtctgctgcta

SEQ ID NO: 40630 - DNA, 26 bp, Artificial Sequence
  Synthetic Construct
cactgaactagttggtttctcacaca

SEQ ID NO: 40631 - DNA, 23 bp, Artificial Sequence
  Synthetic Construct
agcaatggaaaacacctccatgt

SEQ ID NO: 40632 - DNA, 24 bp, Artificial Sequence
  Synthetic Construct
tgcaaacatctttggaagggatct

SEQ ID NO: 40633 - DNA, 26 bp, Artificial Sequence
  Synthetic Construct
ggatctagtgattgttaggccaggtt

SEQ ID NO: 40634 - DNA, 23 bp, Artificial Sequence
  Synthetic Construct
ccccacaagtaggaggctgtagt

SEQ ID NO: 40635 - DNA, 24 bp, Artificial Sequence
  Synthetic Construct
tcaaaacagcttggtaacccacat

SEQ ID NO: 40636 - DNA, 25 bp, Artificial Sequence
  Synthetic Construct
ggaatgtccactccataaccacaca

SEQ ID NO: 40637 - DNA, 21 bp, Artificial Sequence
  Synthetic Construct
gcccgagggagagattgaaga

SEQ ID NO: 40638 - DNA, 24 bp, Artificial Sequence
  Synthetic Construct
ccgtagcctgggaggaatgtttac

SEQ ID NO: 40639 - DNA, 24 bp, Artificial Sequence
  Synthetic Construct
ccattgcagaaactcgctatcctt

SEQ ID NO: 40640 - DNA, 22 bp, Artificial Sequence
  Synthetic Construct
gtcagctactgggcaagaggaa

SEQ ID NO: 40641 - DNA, 23 bp, Artificial Sequence
  Synthetic Construct
gtctcagctgtcttagcgtcaca

SEQ ID NO: 40642 - DNA, 20 bp, Artificial Sequence
  Synthetic Construct
tctcgctctgacctcaccat

SEQ ID NO: 40643 - DNA, 20 bp, Artificial Sequence
  Synthetic Construct
tggtgacgggagttggaatg

SEQ ID NO: 40644 - DNA, 23 bp, Artificial Sequence
  Synthetic Construct
ccatttcagccatctaccactgt

SEQ ID NO: 40645 - DNA, 22 bp, Artificial Sequence
  Synthetic Construct
ccaacctcagaggggcaaattc

SEQ ID NO: 40646 - DNA, 22 bp, Artificial Sequence
  Synthetic Construct
gttccctggaggtatccgaatg

SEQ ID NO: 40647 - DNA, 18 bp, Artificial Sequence
  Synthetic Construct
ccttggcccgcctcaaaa

SEQ ID NO: 40648 - DNA, 22 bp, Artificial Sequence
  Synthetic Construct
ggcatggctgtgacttgctttg

SEQ ID NO: 40649 - DNA, 25 bp, Artificial Sequence
  Synthetic Construct
cacactgaaaataaaagggcggaaa

SEQ ID NO: 40650 - DNA, 22 bp, Artificial Sequence
  Synthetic Construct
cggaatgaggatggcagttaca

SEQ ID NO: 40651 - DNA, 21 bp, Artificial Sequence
  Synthetic Construct
gcctgtgccatcacgcttaga

SEQ ID NO: 40652 - DNA, 22 bp, Artificial Sequence
  Synthetic Construct
acaaggaagctgtcactggttt

SEQ ID NO: 40653 - DNA, 20 bp, Artificial Sequence
  Synthetic Construct
aggagcacggctgtgaagat

SEQ ID NO: 40654 - DNA, 24 bp, Artificial Sequence
  Synthetic Construct
gctagaggatcgctaggtggttac

SEQ ID NO: 40655 - DNA, 23 bp, Artificial Sequence
  Synthetic Construct
gctccgggcttcagttttaggta

SEQ ID NO: 40656 - DNA, 20 bp, Artificial Sequence
  Synthetic Construct
agggttacgggcagagaact

SEQ ID NO: 40657 - DNA, 20 bp, Artificial Sequence
  Synthetic Construct
ccctctccaccctcctcaga

SEQ ID NO: 40658 - DNA, 23 bp, Artificial Sequence
  Synthetic Construct
gtgtgaatgccctcagtcaggtt

SEQ ID NO: 40659 - DNA, 18 bp, Artificial Sequence
  Synthetic Construct
acacagtgctggctgcaa

SEQ ID NO: 40660 - DNA, 25 bp, Artificial Sequence
  Synthetic Construct
gaagctcttacccctaactcgattg

SEQ ID NO: 40661 - DNA, 22 bp, Artificial Sequence
  Synthetic Construct
tgatgggcttcctgggaggtaa

SEQ ID NO: 40662 - DNA, 22 bp, Artificial Sequence
  Synthetic Construct
tggttgactgccagacctcaga

SEQ ID NO: 40663 - DNA, 20 bp, Artificial Sequence
  Synthetic Construct
tcttggcagacagggagact

SEQ ID NO: 40664 - DNA, 19 bp, Artificial Sequence
  Synthetic Construct
gcagcttgctgccacacaa

SEQ ID NO: 40665 - DNA, 21 bp, Artificial Sequence
  Synthetic Construct
tgagggcctgctaggatcttg

SEQ ID NO: 40666 - DNA, 24 bp, Artificial Sequence
  Synthetic Construct
gcagtcgccaacttctgggtttag

SEQ ID NO: 40667 - DNA, 20 bp, Artificial Sequence
  Synthetic Construct
gtcaaagctggcctgcatca

SEQ ID NO: 40668 - DNA, 20 bp, Artificial Sequence
  Synthetic Construct
actgctgccctctgctggat

SEQ ID NO: 40669 - DNA, 22 bp, Artificial Sequence
  Synthetic Construct
cctctccaaccccaaagtctgt

SEQ ID NO: 40670 - DNA, 21 bp, Artificial Sequence
  Synthetic Construct
tggtcttgccctctggagcat

SEQ ID NO: 40671 - DNA, 23 bp, Artificial Sequence
  Synthetic Construct
ggcttagaaggattccagcaact

SEQ ID NO: 40672 - DNA, 20 bp, Artificial Sequence
  Synthetic Construct
gcaaggagcacatcgcttgt

SEQ ID NO: 40673 - DNA, 20 bp, Artificial Sequence
  Synthetic Construct
tgtgagtgcagagggcatgt

SEQ ID NO: 40674 - DNA, 22 bp, Artificial Sequence
  Synthetic Construct
acttccgggtagtgggtctgtt

SEQ ID NO: 40675 - DNA, 22 bp, Artificial Sequence
  Synthetic Construct
gggtttcacgtgggaaggcaaa

SEQ ID NO: 40676 - DNA, 25 bp, Artificial Sequence
  Synthetic Construct
aggactagctgtgtaccagaatctt

SEQ ID NO: 40677 - DNA, 22 bp, Artificial Sequence
  Synthetic Construct
cagcttactggctgtcctgaga

SEQ ID NO: 40678 - DNA, 22 bp, Artificial Sequence
  Synthetic Construct
cccaaccagggatatccagact

SEQ ID NO: 40679 - DNA, 22 bp, Artificial Sequence
  Synthetic Construct
ccatcacagcctgtccatctca

SEQ ID NO: 40680 - DNA, 20 bp, Artificial Sequence
  Synthetic Construct
cacagaggccgagtcaaaca

SEQ ID NO: 40681 - DNA, 23 bp, Artificial Sequence
  Synthetic Construct
ggaaggggcagcagtttatcctt

SEQ ID NO: 40682 - DNA, 20 bp, Artificial Sequence
  Synthetic Construct
tggggaaagtgctgccaaag

SEQ ID NO: 40683 - DNA, 28 bp, Artificial Sequence
  Synthetic Construct
gggtcaatcgttggcattatctgaggaa

SEQ ID NO: 40684 - DNA, 21 bp, Artificial Sequence
  Synthetic Construct
ttaccacctcgccccttgagt

SEQ ID NO: 40685 - DNA, 25 bp, Artificial Sequence
  Synthetic Construct
catttcataccttgcacttccagtt

SEQ ID NO: 40686 - DNA, 25 bp, Artificial Sequence
  Synthetic Construct
ccagccactaattttccaccctgat

SEQ ID NO: 40687 - DNA, 24 bp, Artificial Sequence
  Synthetic Construct
ccatgtctgtcatccctgaattgt

SEQ ID NO: 40688 - DNA, 19 bp, Artificial Sequence
  Synthetic Construct
gcagccggctccatcagtt

SEQ ID NO: 40689 - DNA, 21 bp, Artificial Sequence
  Synthetic Construct
aggtagatgcctctggctcaa

SEQ ID NO: 40690 - DNA, 23 bp, Artificial Sequence
  Synthetic Construct
cctctgtcgtatcaccgggagaa

SEQ ID NO: 40691 - DNA, 22 bp, Artificial Sequence
  Synthetic Construct
ccgatgctgccttaacctcctt

SEQ ID NO: 40692 - DNA, 22 bp, Artificial Sequence
  Synthetic Construct
ctgctccttccagaagccaaac

SEQ ID NO: 40693 - DNA, 24 bp, Artificial Sequence
  Synthetic Construct
ggacaaacccagagtctcgatgta

SEQ ID NO: 40694 - DNA, 26 bp, Artificial Sequence
  Synthetic Construct
cgaggttttaagaagtgaggctagtt

SEQ ID NO: 40695 - DNA, 23 bp, Artificial Sequence
  Synthetic Construct
acagaagacccgagaaggatgta

SEQ ID NO: 40696 - DNA, 24 bp, Artificial Sequence
  Synthetic Construct
gcaagatgctgttttcttcaccaa

SEQ ID NO: 40697 - DNA, 21 bp, Artificial Sequence
  Synthetic Construct
tgaaccccgtctcagtgactt

SEQ ID NO: 40698 - DNA, 24 bp, Artificial Sequence
  Synthetic Construct
aaagaaaggccctgtaaacagact

SEQ ID NO: 40699 - DNA, 20 bp, Artificial Sequence
  Synthetic Construct
aaccgggacagacggcttca

SEQ ID NO: 40700 - DNA, 30 bp, Artificial Sequence
  Synthetic Construct
gcagaggaggattttgataatcaggtagat

SEQ ID NO: 40701 - DNA, 21 bp, Artificial Sequence
  Synthetic Construct
tgatatcggggcagctctgaa

SEQ ID NO: 40702 - DNA, 23 bp, Artificial Sequence
  Synthetic Construct
ggctgtattgccagagaaacctt

SEQ ID NO: 40703 - DNA, 25 bp, Artificial Sequence
  Synthetic Construct
ccagaaaagcaagcacttgtgtgaa

SEQ ID NO: 40704 - DNA, 26 bp, Artificial Sequence
  Synthetic Construct
agctacccaaacctttattcctgaag

SEQ ID NO: 40705 - DNA, 27 bp, Artificial Sequence
  Synthetic Construct
ggccatgcttgacaggtgtctaaaact

SEQ ID NO: 40706 - DNA, 25 bp, Artificial Sequence
  Synthetic Construct
gggaaaaataggtgctggcccttta

SEQ ID NO: 40707 - DNA, 20 bp, Artificial Sequence
  Synthetic Construct
ctagaagggtggccctcaga

SEQ ID NO: 40708 - DNA, 21 bp, Artificial Sequence
  Synthetic Construct
ggtgggctgcatatgactgaa

SEQ ID NO: 40709 - DNA, 23 bp, Artificial Sequence
  Synthetic Construct
ggcagtgcctttgggtaaagcaa

SEQ ID NO: 40710 - DNA, 25 bp, Artificial Sequence
  Synthetic Construct
acaactttgacttccaaacctcagt

SEQ ID NO: 40711 - DNA, 21 bp, Artificial Sequence
  Synthetic Construct
cctacagagggaagcccaaac

SEQ ID NO: 40712 - DNA, 19 bp, Artificial Sequence
  Synthetic Construct
agcagccgggcaagggaat

SEQ ID NO: 40713 - DNA, 23 bp, Artificial Sequence
  Synthetic Construct
gttcttcacccgttttgaacagt

SEQ ID NO: 40714 - DNA, 27 bp, Artificial Sequence
  Synthetic Construct
gcttatgtctcccaattctctggtgat

SEQ ID NO: 40715 - DNA, 22 bp, Artificial Sequence
  Synthetic Construct
tgttcaggatctgggcagagtt

SEQ ID NO: 40716 - DNA, 19 bp, Artificial Sequence
  Synthetic Construct
acagcccctcagccagttc

SEQ ID NO: 40717 - DNA, 21 bp, Artificial Sequence
  Synthetic Construct
tgggaggaccaggtaccgatt

SEQ ID NO: 40718 - DNA, 24 bp, Artificial Sequence
  Synthetic Construct
ggagccttgcattcagataacctt

SEQ ID NO: 40719 - DNA, 23 bp, Artificial Sequence
  Synthetic Construct
gctggtggtcagagtcaggttag

SEQ ID NO: 40720 - DNA, 22 bp, Artificial Sequence
  Synthetic Construct
agttgagatggggttgggacta

SEQ ID NO: 40721 - DNA, 20 bp, Artificial Sequence
  Synthetic Construct
tgcctgggttgctcttccaa

SEQ ID NO: 40722 - DNA, 20 bp, Artificial Sequence
  Synthetic Construct
aatgaccacctggccctgta

SEQ ID NO: 40723 - DNA, 19 bp, Artificial Sequence
  Synthetic Construct
cgcacaatggctgccaact

SEQ ID NO: 40724 - DNA, 23 bp, Artificial Sequence
  Synthetic Construct
acaggacaaacttgctgtgacaa

SEQ ID NO: 40725 - DNA, 22 bp, Artificial Sequence
  Synthetic Construct
ggcccaatagacaccaccatga

SEQ ID NO: 40726 - DNA, 24 bp, Artificial Sequence
  Synthetic Construct
ccacagccaatcaatcagggaatc

SEQ ID NO: 40727 - DNA, 23 bp, Artificial Sequence
  Synthetic Construct
gcggaagctataggtggactaag

SEQ ID NO: 40728 - DNA, 22 bp, Artificial Sequence
  Synthetic Construct
cagcctcctctgtctctggaaa

SEQ ID NO: 40729 - DNA, 25 bp, Artificial Sequence
  Synthetic Construct
caaggacgacattcctcctaacttg

SEQ ID NO: 40730 - DNA, 25 bp, Artificial Sequence
  Synthetic Construct
gactcgttcatgcaatgaggtgaaa

SEQ ID NO: 40731 - DNA, 23 bp, Artificial Sequence
  Synthetic Construct
gcttggaaatgagcgtgtagctt

SEQ ID NO: 40732 - DNA, 22 bp, Artificial Sequence
  Synthetic Construct
cctctcttccttgctggctgta

SEQ ID NO: 40733 - DNA, 18 bp, Artificial Sequence
  Synthetic Construct
tgccacaatgccgtgagt

SEQ ID NO: 40734 - DNA, 24 bp, Artificial Sequence
  Synthetic Construct
cctccacctgtctgtcaaaagtct

SEQ ID NO: 40735 - DNA, 20 bp, Artificial Sequence
  Synthetic Construct
aaagcacacgccggattttc

SEQ ID NO: 40736 - DNA, 30 bp, Artificial Sequence
  Synthetic Construct
gctttcccatatgttatcccatttgtgctt

SEQ ID NO: 40737 - DNA, 21 bp, Artificial Sequence
  Synthetic Construct
tctctgtggcccagtccctta

SEQ ID NO: 40738 - DNA, 20 bp, Artificial Sequence
  Synthetic Construct
tcccctcagtgggcctgtgt

SEQ ID NO: 40739 - DNA, 21 bp, Artificial Sequence
  Synthetic Construct
agggcgattctgtggctgatg

SEQ ID NO: 40740 - DNA, 21 bp, Artificial Sequence
  Synthetic Construct
aatgggagaggtggccagtca

SEQ ID NO: 40741 - DNA, 24 bp, Artificial Sequence
  Synthetic Construct
aatcttgagaacaaggtggggaaa

SEQ ID NO: 40742 - DNA, 25 bp, Artificial Sequence
  Synthetic Construct
ggagttcaactttccaggagaagaa

SEQ ID NO: 40743 - DNA, 21 bp, Artificial Sequence
  Synthetic Construct
ggaatcagggccatgaacagt

SEQ ID NO: 40744 - DNA, 20 bp, Artificial Sequence
  Synthetic Construct
aatgcccaggccacactgta

SEQ ID NO: 40745 - DNA, 21 bp, Artificial Sequence
  Synthetic Construct
tgatcgtcgttgagcaagtgt

SEQ ID NO: 40746 - DNA, 24 bp, Artificial Sequence
  Synthetic Construct
gatgagaatgaggagggtggaatc

SEQ ID NO: 40747 - DNA, 27 bp, Artificial Sequence
  Synthetic Construct
ggaacaagctttactcacatagagaag

SEQ ID NO: 40748 - DNA, 25 bp, Artificial Sequence
  Synthetic Construct
cttttaaaacgagcgttggctaaac

SEQ ID NO: 40749 - DNA, 24 bp, Artificial Sequence
  Synthetic Construct
ccagccaccttagcttctcctatg

SEQ ID NO: 40750 - DNA, 20 bp, Artificial Sequence
  Synthetic Construct
tggacagccatcctggtgta

SEQ ID NO: 40751 - DNA, 19 bp, Artificial Sequence
  Synthetic Construct
gccgtgcactcatgccatt

SEQ ID NO: 40752 - DNA, 25 bp, Artificial Sequence
  Synthetic Construct
aatcttttctcaggattccgtctgt

SEQ ID NO: 40753 - DNA, 20 bp, Artificial Sequence
  Synthetic Construct
agggaaacactggggcaaac

SEQ ID NO: 40754 - DNA, 24 bp, Artificial Sequence
  Synthetic Construct
ggctgtccatttcaggggatcctt

SEQ ID NO: 40755 - DNA, 21 bp, Artificial Sequence
  Synthetic Construct
gggagcagagagatggagaga

SEQ ID NO: 40756 - DNA, 22 bp, Artificial Sequence
  Synthetic Construct
tggagttaagcaccctccctat

SEQ ID NO: 40757 - DNA, 24 bp, Artificial Sequence
  Synthetic Construct
cagctacattgagggcaatgtctt

SEQ ID NO: 40758 - DNA, 22 bp, Artificial Sequence
  Synthetic Construct
ggggagcatggattctggaaca

SEQ ID NO: 40759 - DNA, 25 bp, Artificial Sequence
  Synthetic Construct
gggcaaaacagacagaaaggtgttg

SEQ ID NO: 40760 - DNA, 26 bp, Artificial Sequence
  Synthetic Construct
ggaagcgatgttaggttaagactaga

SEQ ID NO: 40761 - DNA, 20 bp, Artificial Sequence
  Synthetic Construct
ctgcgtcatccctagcacaa

SEQ ID NO: 40762 - DNA, 22 bp, Artificial Sequence
  Synthetic Construct
ccctggctgtgaggttttagat

SEQ ID NO: 40763 - DNA, 20 bp, Artificial Sequence
  Synthetic Construct
tttgctcggcagccagacat

SEQ ID NO: 40764 - DNA, 22 bp, Artificial Sequence
  Synthetic Construct
cgacagcagagcatcagctaaa

SEQ ID NO: 40765 - DNA, 23 bp, Artificial Sequence
  Synthetic Construct
gccctttcctctgacttaggttt

SEQ ID NO: 40766 - DNA, 20 bp, Artificial Sequence
  Synthetic Construct
gcctcatgcctgcagttcaa

SEQ ID NO: 40767 - DNA, 22 bp, Artificial Sequence
  Synthetic Construct
gccccaatcacaaactgagcat

SEQ ID NO: 40768 - DNA, 24 bp, Artificial Sequence
  Synthetic Construct
tgagggattaacaacggtcaaaca

SEQ ID NO: 40769 - DNA, 24 bp, Artificial Sequence
  Synthetic Construct
gaggtccagtctctttcaccgtat

SEQ ID NO: 40770 - DNA, 21 bp, Artificial Sequence
  Synthetic Construct
gccacctgtttggaggtgagt

SEQ ID NO: 40771 - DNA, 22 bp, Artificial Sequence
  Synthetic Construct
ggtttgcggggaggaaagatga

SEQ ID NO: 40772 - DNA, 22 bp, Artificial Sequence
  Synthetic Construct
gggattgggtggcctagtttga

SEQ ID NO: 40773 - DNA, 21 bp, Artificial Sequence
  Synthetic Construct
gaggaagggaagagcaagcaa

SEQ ID NO: 40774 - DNA, 21 bp, Artificial Sequence
  Synthetic Construct
gcagcacacatcctgtagtga

SEQ ID NO: 40775 - DNA, 23 bp, Artificial Sequence
  Synthetic Construct
gcaagctgaaactctgggcatgt

SEQ ID NO: 40776 - DNA, 23 bp, Artificial Sequence
  Synthetic Construct
catccctggaattagcagtgtct

SEQ ID NO: 40777 - DNA, 23 bp, Artificial Sequence
  Synthetic Construct
gaagagtgagcttcttgcacagt

SEQ ID NO: 40778 - DNA, 21 bp, Artificial Sequence
  Synthetic Construct
gcccaggttccaaccctgatt

SEQ ID NO: 40779 - DNA, 25 bp, Artificial Sequence
  Synthetic Construct
gcttctagtattagcccttcctgtt

SEQ ID NO: 40780 - DNA, 22 bp, Artificial Sequence
  Synthetic Construct
cccctgggcttatgaaccaaac

SEQ ID NO: 40781 - DNA, 20 bp, Artificial Sequence
  Synthetic Construct
ccaccaccacactgttctgt

SEQ ID NO: 40782 - DNA, 23 bp, Artificial Sequence
  Synthetic Construct
gcaaaagtgattggggccagctt

SEQ ID NO: 40783 - DNA, 22 bp, Artificial Sequence
  Synthetic Construct
ggctgggaagctgatgagtcaa

SEQ ID NO: 40784 - DNA, 24 bp, Artificial Sequence
  Synthetic Construct
ggaccagctcaaatgttctcttgt

SEQ ID NO: 40785 - DNA, 25 bp, Artificial Sequence
  Synthetic Construct
ctctggaagatggtggcataaggaa

SEQ ID NO: 40786 - DNA, 22 bp, Artificial Sequence
  Synthetic Construct
agattgccacctggacactttg

SEQ ID NO: 40787 - DNA, 22 bp, Artificial Sequence
  Synthetic Construct
gggatggtgatggggatgacta

SEQ ID NO: 40788 - DNA, 24 bp, Artificial Sequence
  Synthetic Construct
gggagagcaacaagagggaaggat

SEQ ID NO: 40789 - DNA, 25 bp, Artificial Sequence
  Synthetic Construct
gctacacaaactgcatctcttggaa

SEQ ID NO: 40790 - DNA, 24 bp, Artificial Sequence
  Synthetic Construct
ggtgacctagctggggtagtatgt

SEQ ID NO: 40791 - DNA, 22 bp, Artificial Sequence
  Synthetic Construct
ctcctgcaggtggttcaaggta

SEQ ID NO: 40792 - DNA, 20 bp, Artificial Sequence
  Synthetic Construct
ttagaggcaggggcagaaga

SEQ ID NO: 40793 - DNA, 24 bp, Artificial Sequence
  Synthetic Construct
ctctacttccaaggtggtgcctta

SEQ ID NO: 40794 - DNA, 24 bp, Artificial Sequence
  Synthetic Construct
gaaattcagtgggctgagaacctt

SEQ ID NO: 40795 - DNA, 21 bp, Artificial Sequence
  Synthetic Construct
tcagccctctgcatcctgcta

SEQ ID NO: 40796 - DNA, 20 bp, Artificial Sequence
  Synthetic Construct
ttccacagcagggtggtact

SEQ ID NO: 40797 - DNA, 24 bp, Artificial Sequence
  Synthetic Construct
gtgaggcatgcgcagataagattc

SEQ ID NO: 40798 - DNA, 22 bp, Artificial Sequence
  Synthetic Construct
cgtgcctcctgcaagatgaaga

SEQ ID NO: 40799 - DNA, 26 bp, Artificial Sequence
  Synthetic Construct
ggtgaaggactcagtgtccagcatag

SEQ ID NO: 40800 - DNA, 23 bp, Artificial Sequence
  Synthetic Construct
ggtgacactgccagtaacagcaa

SEQ ID NO: 40801 - DNA, 24 bp, Artificial Sequence
  Synthetic Construct
gccctccccttgtattcattccat

SEQ ID NO: 40802 - DNA, 18 bp, Artificial Sequence
  Synthetic Construct
tgagcccagacccacctt

SEQ ID NO: 40803 - DNA, 26 bp, Artificial Sequence
  Synthetic Construct
ctggaactgctggttaatcttgaatc

SEQ ID NO: 40804 - DNA, 22 bp, Artificial Sequence
  Synthetic Construct
tctccagcgtcatggactcaag

SEQ ID NO: 40805 - DNA, 27 bp, Artificial Sequence
  Synthetic Construct
ggtagaaagaaacaattccaggtcaga

SEQ ID NO: 40806 - DNA, 22 bp, Artificial Sequence
  Synthetic Construct
gggttttcaggggtgggtttga

SEQ ID NO: 40807 - DNA, 24 bp, Artificial Sequence
  Synthetic Construct
gcagatggaggttaccaaacttgt

SEQ ID NO: 40808 - DNA, 20 bp, Artificial Sequence
  Synthetic Construct
tgctctgtggggtgccattt

SEQ ID NO: 40809 - DNA, 25 bp, Artificial Sequence
  Synthetic Construct
ccctcttaccccattctcagctctt

SEQ ID NO: 40810 - DNA, 21 bp, Artificial Sequence
  Synthetic Construct
tccccttcctctctgccctta

SEQ ID NO: 40811 - DNA, 21 bp, Artificial Sequence
  Synthetic Construct
aacatctgccgaccgagttag

SEQ ID NO: 40812 - DNA, 25 bp, Artificial Sequence
  Synthetic Construct
cccttaaagtcccaggttaatgagt

SEQ ID NO: 40813 - DNA, 20 bp, Artificial Sequence
  Synthetic Construct
acctggatgcccctgatgat

SEQ ID NO: 40814 - DNA, 24 bp, Artificial Sequence
  Synthetic Construct
gcctttgcattgttttggccattg

SEQ ID NO: 40815 - DNA, 22 bp, Artificial Sequence
  Synthetic Construct
agttttgccagcacttctggat

SEQ ID NO: 40816 - DNA, 24 bp, Artificial Sequence
  Synthetic Construct
ggagtttgagagccaggaggtttc

SEQ ID NO: 40817 - DNA, 22 bp, Artificial Sequence
  Synthetic Construct
ctgatcaaagggcaaggagact

SEQ ID NO: 40818 - DNA, 22 bp, Artificial Sequence
  Synthetic Construct
gctaaggtgggaagggctgttt

SEQ ID NO: 40819 - DNA, 21 bp, Artificial Sequence
  Synthetic Construct
tggggtaaacggtgccataga

SEQ ID NO: 40820 - DNA, 24 bp, Artificial Sequence
  Synthetic Construct
gcctagaattgcaagagtccatga

SEQ ID NO: 40821 - DNA, 22 bp, Artificial Sequence
  Synthetic Construct
gggatggcagcttatgcctaca

SEQ ID NO: 40822 - DNA, 25 bp, Artificial Sequence
  Synthetic Construct
ccctaggagagaagacactttgtga

SEQ ID NO: 40823 - DNA, 25 bp, Artificial Sequence
  Synthetic Construct
ccaccatagacagaaacctgtttga

SEQ ID NO: 40824 - DNA, 20 bp, Artificial Sequence
  Synthetic Construct
ccatgcaacccgaggctcta

SEQ ID NO: 40825 - DNA, 22 bp, Artificial Sequence
  Synthetic Construct
cctaggcacctgagtgctcaaa

SEQ ID NO: 40826 - DNA, 21 bp, Artificial Sequence
  Synthetic Construct
gatttgcctccttggcctgaa

SEQ ID NO: 40827 - DNA, 22 bp, Artificial Sequence
  Synthetic Construct
gctcatggctgattcactcact

SEQ ID NO: 40828 - DNA, 19 bp, Artificial Sequence
  Synthetic Construct
cccgtcccaggtgtcatgt

SEQ ID NO: 40829 - DNA, 20 bp, Artificial Sequence
  Synthetic Construct
ggctgaaaaggtgcctgctt

SEQ ID NO: 40830 - DNA, 25 bp, Artificial Sequence
  Synthetic Construct
ttggtaagaagaaggtgcaaaggta

SEQ ID NO: 40831 - DNA, 22 bp, Artificial Sequence
  Synthetic Construct
ggactgtaagccaggactctct

SEQ ID NO: 40832 - DNA, 24 bp, Artificial Sequence
  Synthetic Construct
cccctgcccctaaaacttgtcttc

SEQ ID NO: 40833 - DNA, 23 bp, Artificial Sequence
  Synthetic Construct
gctgccaacatctgtgactgtag

SEQ ID NO: 40834 - DNA, 25 bp, Artificial Sequence
  Synthetic Construct
ggagagagaaccctgatcaaatcat

SEQ ID NO: 40835 - DNA, 20 bp, Artificial Sequence
  Synthetic Construct
acgaacgcacacgggacttt

SEQ ID NO: 40836 - DNA, 25 bp, Artificial Sequence
  Synthetic Construct
ctggtgcttccaacactaaaagcaa

SEQ ID NO: 40837 - DNA, 25 bp, Artificial Sequence
  Synthetic Construct
agaataaaatctgcaaggggctgta

SEQ ID NO: 40838 - DNA, 25 bp, Artificial Sequence
  Synthetic Construct
cgaaacacacaaggatgggaaagaa

SEQ ID NO: 40839 - DNA, 23 bp, Artificial Sequence
  Synthetic Construct
gtggagctcatctctctccaaag

SEQ ID NO: 40840 - DNA, 23 bp, Artificial Sequence
  Synthetic Construct
gtctttaccaccttcagccttgt

SEQ ID NO: 40841 - DNA, 21 bp, Artificial Sequence
  Synthetic Construct
gggcccagacactatgtgctt

SEQ ID NO: 40842 - DNA, 20 bp, Artificial Sequence
  Synthetic Construct
ggatcaggctgctggactgt

SEQ ID NO: 40843 - DNA, 24 bp, Artificial Sequence
  Synthetic Construct
ggttgtagaactacagtccccatt

SEQ ID NO: 40844 - DNA, 24 bp, Artificial Sequence
  Synthetic Construct
gggttaattcagggtctccactct

SEQ ID NO: 40845 - DNA, 23 bp, Artificial Sequence
  Synthetic Construct
ggggtcaacaaatgtgggctaga

SEQ ID NO: 40846 - DNA, 30 bp, Artificial Sequence
  Synthetic Construct
cgagaaacggatcattaaacagtagtgtga

SEQ ID NO: 40847 - DNA, 26 bp, Artificial Sequence
  Synthetic Construct
cctaaaataccttcctccgattgctt

SEQ ID NO: 40848 - DNA, 23 bp, Artificial Sequence
  Synthetic Construct
cgctggtttctggcttcagaact

SEQ ID NO: 40849 - DNA, 21 bp, Artificial Sequence
  Synthetic Construct
agacttcaggcagggagctta

SEQ ID NO: 40850 - DNA, 20 bp, Artificial Sequence
  Synthetic Construct
tgcacacacagcccctcaat

SEQ ID NO: 40851 - DNA, 19 bp, Artificial Sequence
  Synthetic Construct
agggtcctccaccctctga

SEQ ID NO: 40852 - DNA, 23 bp, Artificial Sequence
  Synthetic Construct
ggcagagagtgaaagggaagtag

SEQ ID NO: 40853 - DNA, 24 bp, Artificial Sequence
  Synthetic Construct
caacttcaccaggggtttatcact

SEQ ID NO: 40854 - DNA, 20 bp, Artificial Sequence
  Synthetic Construct
agtccaagcctgggtccaaa

SEQ ID NO: 40855 - DNA, 26 bp, Artificial Sequence
  Synthetic Construct
cagaccttcatgctgaggtgaatttg

SEQ ID NO: 40856 - DNA, 25 bp, Artificial Sequence
  Synthetic Construct
cccatccaaggggctataaaagtga

SEQ ID NO: 40857 - DNA, 22 bp, Artificial Sequence
  Synthetic Construct
agtagggtggttcccagcagat

SEQ ID NO: 40858 - DNA, 22 bp, Artificial Sequence
  Synthetic Construct
gtgctcatgccagcagcaatag

SEQ ID NO: 40859 - DNA, 23 bp, Artificial Sequence
  Synthetic Construct
agaggaacagagcagttttgcat

SEQ ID NO: 40860 - DNA, 20 bp, Artificial Sequence
  Synthetic Construct
gcccatgccaacaaggtgaa

SEQ ID NO: 40861 - DNA, 24 bp, Artificial Sequence
  Synthetic Construct
ggggatgagcagaagggagagttt

SEQ ID NO: 40862 - DNA, 24 bp, Artificial Sequence
  Synthetic Construct
tttctttcagtggctaagctgttg

SEQ ID NO: 40863 - DNA, 22 bp, Artificial Sequence
  Synthetic Construct
ggttgtggctgtaacctgcatt

SEQ ID NO: 40864 - DNA, 25 bp, Artificial Sequence
  Synthetic Construct
cctggatatcgagcaacaagaaaga

SEQ ID NO: 40865 - DNA, 23 bp, Artificial Sequence
  Synthetic Construct
gaagatggcagcatggaatctca

SEQ ID NO: 40866 - DNA, 20 bp, Artificial Sequence
  Synthetic Construct
acaagtatggcggggctgta

SEQ ID NO: 40867 - DNA, 21 bp, Artificial Sequence
  Synthetic Construct
tccgccaatggtgagagaaag

SEQ ID NO: 40868 - DNA, 25 bp, Artificial Sequence
  Synthetic Construct
ccaaatcctgggatcctgtgaggta

SEQ ID NO: 40869 - DNA, 19 bp, Artificial Sequence
  Synthetic Construct
tcacgggcaggccagagta

SEQ ID NO: 40870 - DNA, 19 bp, Artificial Sequence
  Synthetic Construct
agcagcaccctctgtggaa

SEQ ID NO: 40871 - DNA, 23 bp, Artificial Sequence
  Synthetic Construct
actaagacagtgacctgctccat

SEQ ID NO: 40872 - DNA, 25 bp, Artificial Sequence
  Synthetic Construct
ccaaaccatatcaatgacccaccaa

SEQ ID NO: 40873 - DNA, 22 bp, Artificial Sequence
  Synthetic Construct
agcttccctaacatgccagttt

SEQ ID NO: 40874 - DNA, 27 bp, Artificial Sequence
  Synthetic Construct
tgatgtcaagtaactacccagatgttc

SEQ ID NO: 40875 - DNA, 20 bp, Artificial Sequence
  Synthetic Construct
cctgagcctgcccaggtttt

SEQ ID NO: 40876 - DNA, 22 bp, Artificial Sequence
  Synthetic Construct
ggaggaaggtggctggattttg

SEQ ID NO: 40877 - DNA, 18 bp, Artificial Sequence
  Synthetic Construct
ttgccccaggtgctctgt

SEQ ID NO: 40878 - DNA, 22 bp, Artificial Sequence
  Synthetic Construct
tgtcccagctccatccctttct

SEQ ID NO: 40879 - DNA, 21 bp, Artificial Sequence
  Synthetic Construct
aagctgctgggactggacaca

SEQ ID NO: 40880 - DNA, 20 bp, Artificial Sequence
  Synthetic Construct
cctgccccaggggttctttc

SEQ ID NO: 40881 - DNA, 27 bp, Artificial Sequence
  Synthetic Construct
gccataaatgggtcctctgaggcaata

SEQ ID NO: 40882 - DNA, 23 bp, Artificial Sequence
  Synthetic Construct
gtatggctagctgctacatgtct

SEQ ID NO: 40883 - DNA, 21 bp, Artificial Sequence
  Synthetic Construct
ttgcttggggcaggaggacta

SEQ ID NO: 40884 - DNA, 20 bp, Artificial Sequence
  Synthetic Construct
tgggtgggcacaggctggta

SEQ ID NO: 40885 - DNA, 24 bp, Artificial Sequence
  Synthetic Construct
ggctgacatagggcactgtcttac

SEQ ID NO: 40886 - DNA, 21 bp, Artificial Sequence
  Synthetic Construct
actgtgtgtgcttcagctgtt

SEQ ID NO: 40887 - DNA, 26 bp, Artificial Sequence
  Synthetic Construct
cgcaaatcagttaatgggtacggtaa

SEQ ID NO: 40888 - DNA, 20 bp, Artificial Sequence
  Synthetic Construct
tgctggcagagcatccctaa

SEQ ID NO: 40889 - DNA, 20 bp, Artificial Sequence
  Synthetic Construct
cctcagtgcaagccagacat

SEQ ID NO: 40890 - DNA, 19 bp, Artificial Sequence
  Synthetic Construct
tctgggcgaccgtccacat

SEQ ID NO: 40891 - DNA, 25 bp, Artificial Sequence
  Synthetic Construct
ctgctttctcatacctccagccttt

SEQ ID NO: 40892 - DNA, 23 bp, Artificial Sequence
  Synthetic Construct
gggattgacaggtggaaacttca

SEQ ID NO: 40893 - DNA, 20 bp, Artificial Sequence
  Synthetic Construct
ctgcaagaagggctgtggaa

SEQ ID NO: 40894 - DNA, 21 bp, Artificial Sequence
  Synthetic Construct
aagacccaggctgctggaaga

SEQ ID NO: 40895 - DNA, 24 bp, Artificial Sequence
  Synthetic Construct
gctgtgggaaatagtcccatcaca

SEQ ID NO: 40896 - DNA, 24 bp, Artificial Sequence
  Synthetic Construct
ggctaaagttgaaggggcatcatc

SEQ ID NO: 40897 - DNA, 26 bp, Artificial Sequence
  Synthetic Construct
ggaccagtcctttttgtttggactgt

SEQ ID NO: 40898 - DNA, 21 bp, Artificial Sequence
  Synthetic Construct
gctgtggttgaggaagcacta

SEQ ID NO: 40899 - DNA, 22 bp, Artificial Sequence
  Synthetic Construct
tgccattgaattgacccaccaa

SEQ ID NO: 40900 - DNA, 20 bp, Artificial Sequence
  Synthetic Construct
accccgccttatgctgagat

SEQ ID NO: 40901 - DNA, 24 bp, Artificial Sequence
  Synthetic Construct
ccctgtacttacctgtgacacttc

SEQ ID NO: 40902 - DNA, 24 bp, Artificial Sequence
  Synthetic Construct
catctcccctagtcattgctgaga

SEQ ID NO: 40903 - DNA, 20 bp, Artificial Sequence
  Synthetic Construct
tggggcagcaatgtctggaa

SEQ ID NO: 40904 - DNA, 21 bp, Artificial Sequence
  Synthetic Construct
acctgggaggtcctcacttca

SEQ ID NO: 40905 - DNA, 19 bp, Artificial Sequence
  Synthetic Construct
tggctgtgggatggtgagt

SEQ ID NO: 40906 - DNA, 20 bp, Artificial Sequence
  Synthetic Construct
aatcccaccatcgcccagaa

SEQ ID NO: 40907 - DNA, 23 bp, Artificial Sequence
  Synthetic Construct
agcaggtaaccttggaaaacact

SEQ ID NO: 40908 - DNA, 24 bp, Artificial Sequence
  Synthetic Construct
gggacctagacaagtgctgtcctt

SEQ ID NO: 40909 - DNA, 20 bp, Artificial Sequence
  Synthetic Construct
gcgtttcccacttgcctgtt

SEQ ID NO: 40910 - DNA, 21 bp, Artificial Sequence
  Synthetic Construct
ggatagacgctccgcagtgat

SEQ ID NO: 40911 - DNA, 29 bp, Artificial Sequence
  Synthetic Construct
gtcatatacctttataccagaccctgttg

SEQ ID NO: 40912 - DNA, 24 bp, Artificial Sequence
  Synthetic Construct
aaagatttgcttgcctggaagaag

SEQ ID NO: 40913 - DNA, 23 bp, Artificial Sequence
  Synthetic Construct
ccagggaatctgtgggcagaatg

SEQ ID NO: 40914 - DNA, 20 bp, Artificial Sequence
  Synthetic Construct
actgcgggcagatacacaca

SEQ ID NO: 40915 - DNA, 21 bp, Artificial Sequence
  Synthetic Construct
aggtcacaggtgcaaaccatt

SEQ ID NO: 40916 - DNA, 26 bp, Artificial Sequence
  Synthetic Construct
cctgagctgtttctgaactcctcaca

SEQ ID NO: 40917 - DNA, 23 bp, Artificial Sequence
  Synthetic Construct
gttcaggggtttctaccttgcat

SEQ ID NO: 40918 - DNA, 22 bp, Artificial Sequence
  Synthetic Construct
ggctcaagtgatcctcccaagt

SEQ ID NO: 40919 - DNA, 20 bp, Artificial Sequence
  Synthetic Construct
tcacatgccacctcctctga

SEQ ID NO: 40920 - DNA, 24 bp, Artificial Sequence
  Synthetic Construct
cctcgctatatcagggagtagctt

SEQ ID NO: 40921 - DNA, 20 bp, Artificial Sequence
  Synthetic Construct
tgtgaccaccagggttccat

SEQ ID NO: 40922 - DNA, 22 bp, Artificial Sequence
  Synthetic Construct
ggttgactgccacctgaggaat

SEQ ID NO: 40923 - DNA, 22 bp, Artificial Sequence
  Synthetic Construct
tccatctctgggctctgctatc

SEQ ID NO: 40924 - DNA, 23 bp, Artificial Sequence
  Synthetic Construct
tgtggaatgtgagtttcctgtga

SEQ ID NO: 40925 - DNA, 20 bp, Artificial Sequence
  Synthetic Construct
cctcctgccacatgcacact

SEQ ID NO: 40926 - DNA, 22 bp, Artificial Sequence
  Synthetic Construct
gctgtgtttccttgccttggtt

SEQ ID NO: 40927 - DNA, 25 bp, Artificial Sequence
  Synthetic Construct
gggaggaattttccctgtcccaaga

SEQ ID NO: 40928 - DNA, 20 bp, Artificial Sequence
  Synthetic Construct
agagcccatatcccggtctt

SEQ ID NO: 40929 - DNA, 25 bp, Artificial Sequence
  Synthetic Construct
cagagccaaactgtatcaacctagt

SEQ ID NO: 40930 - DNA, 20 bp, Artificial Sequence
  Synthetic Construct
tgtagccagggtggtctctt

SEQ ID NO: 40931 - DNA, 20 bp, Artificial Sequence
  Synthetic Construct
ccaaaatgccgagggccaaa

SEQ ID NO: 40932 - DNA, 22 bp, Artificial Sequence
  Synthetic Construct
ggaaggtcaatgttgcctcaga

SEQ ID NO: 40933 - DNA, 22 bp, Artificial Sequence
  Synthetic Construct
gggttacccttgctccatccaa

SEQ ID NO: 40934 - DNA, 20 bp, Artificial Sequence
  Synthetic Construct
catggctgagctgctgcata

SEQ ID NO: 40935 - DNA, 19 bp, Artificial Sequence
  Synthetic Construct
ggctctcagcctcccttca

SEQ ID NO: 40936 - DNA, 24 bp, Artificial Sequence
  Synthetic Construct
cactggatgatagccacaccatct

SEQ ID NO: 40937 - DNA, 22 bp, Artificial Sequence
  Synthetic Construct
cccaagctacagggctcaaaga

SEQ ID NO: 40938 - DNA, 20 bp, Artificial Sequence
  Synthetic Construct
gtcctgcggtccacaaaatg

SEQ ID NO: 40939 - DNA, 20 bp, Artificial Sequence
  Synthetic Construct
ttctcacctcccaccacaga

SEQ ID NO: 40940 - DNA, 26 bp, Artificial Sequence
  Synthetic Construct
gcagtgagtagagcaaggtaggaact

SEQ ID NO: 40941 - DNA, 22 bp, Artificial Sequence
  Synthetic Construct
gcaagtgtgaacaagtgtggaa

SEQ ID NO: 40942 - DNA, 21 bp, Artificial Sequence
  Synthetic Construct
gcaaggtgaggacaacacagt

SEQ ID NO: 40943 - DNA, 25 bp, Artificial Sequence
  Synthetic Construct
gaaaggtgtctctttacctctgagt

SEQ ID NO: 40944 - DNA, 23 bp, Artificial Sequence
  Synthetic Construct
gtggcattccagaccttgtggta

SEQ ID NO: 40945 - DNA, 21 bp, Artificial Sequence
  Synthetic Construct
ggtgtgcacttgtcggctatg

SEQ ID NO: 40946 - DNA, 26 bp, Artificial Sequence
  Synthetic Construct
ctgtgaatgtgatgctaaggttgttc

SEQ ID NO: 40947 - DNA, 22 bp, Artificial Sequence
  Synthetic Construct
caggccttctggattccgtcta

SEQ ID NO: 40948 - DNA, 20 bp, Artificial Sequence
  Synthetic Construct
tgcacgtaggctggggtaac

SEQ ID NO: 40949 - DNA, 24 bp, Artificial Sequence
  Synthetic Construct
cccgagccttagaaagaccccata

SEQ ID NO: 40950 - DNA, 23 bp, Artificial Sequence
  Synthetic Construct
acagagcttaaggtcaggaccaa

SEQ ID NO: 40951 - DNA, 30 bp, Artificial Sequence
  Synthetic Construct
ccttagtacttaagatgcaagtgtccatac

SEQ ID NO: 40952 - DNA, 23 bp, Artificial Sequence
  Synthetic Construct
ttcctgccagtgttaactcacaa

SEQ ID NO: 40953 - DNA, 23 bp, Artificial Sequence
  Synthetic Construct
ctctgtcaggactccagtctcat

SEQ ID NO: 40954 - DNA, 18 bp, Artificial Sequence
  Synthetic Construct
tgggaggggcaagtggaa

SEQ ID NO: 40955 - DNA, 25 bp, Artificial Sequence
  Synthetic Construct
ccgcttgaggaaaggtgcagattag

SEQ ID NO: 40956 - DNA, 22 bp, Artificial Sequence
  Synthetic Construct
ccatgggttggcaggaaactga

SEQ ID NO: 40957 - DNA, 24 bp, Artificial Sequence
  Synthetic Construct
gaagggtagagcctcatgtctttg

SEQ ID NO: 40958 - DNA, 25 bp, Artificial Sequence
  Synthetic Construct
gagaacaggttgatgacaggttttg

SEQ ID NO: 40959 - DNA, 20 bp, Artificial Sequence
  Synthetic Construct
tgccccactcccaacacact

SEQ ID NO: 40960 - DNA, 23 bp, Artificial Sequence
  Synthetic Construct
cgccagtcagacctaagctcttc

SEQ ID NO: 40961 - DNA, 21 bp, Artificial Sequence
  Synthetic Construct
ggctccccgcatccataaaga

SEQ ID NO: 40962 - DNA, 28 bp, Artificial Sequence
  Synthetic Construct
ccctggaaacatagattgttggttggta

SEQ ID NO: 40963 - DNA, 23 bp, Artificial Sequence
  Synthetic Construct
gtccaggattcagggcctcaaaa

SEQ ID NO: 40964 - DNA, 21 bp, Artificial Sequence
  Synthetic Construct
ccaggttgccacacattctct

SEQ ID NO: 40965 - DNA, 22 bp, Artificial Sequence
  Synthetic Construct
gggctttccctcagacagacaa

SEQ ID NO: 40966 - DNA, 22 bp, Artificial Sequence
  Synthetic Construct
ggaaagtcagcacaggggaaga

SEQ ID NO: 40967 - DNA, 24 bp, Artificial Sequence
  Synthetic Construct
gcacatgttgcaataagccaggta

SEQ ID NO: 40968 - DNA, 23 bp, Artificial Sequence
  Synthetic Construct
gcaccctgtcttttctcaccatt

SEQ ID NO: 40969 - DNA, 20 bp, Artificial Sequence
  Synthetic Construct
gggatgggcagcaacttaca

SEQ ID NO: 40970 - DNA, 22 bp, Artificial Sequence
  Synthetic Construct
cctgcagaactggtgtgacaag

SEQ ID NO: 40971 - DNA, 24 bp, Artificial Sequence
  Synthetic Construct
gaaaagtccaggaggaaacctttg

SEQ ID NO: 40972 - DNA, 22 bp, Artificial Sequence
  Synthetic Construct
gctggtgaaggacgtcaccttt

SEQ ID NO: 40973 - DNA, 25 bp, Artificial Sequence
  Synthetic Construct
gtaaaatcctgccacctctgtaaac

SEQ ID NO: 40974 - DNA, 25 bp, Artificial Sequence
  Synthetic Construct
ggtgtagagtaggtgctcagtcaca

SEQ ID NO: 40975 - DNA, 22 bp, Artificial Sequence
  Synthetic Construct
tggcctcagagctcttgtctct

SEQ ID NO: 40976 - DNA, 20 bp, Artificial Sequence
  Synthetic Construct
tcctcccttttgggcacttg

SEQ ID NO: 40977 - DNA, 25 bp, Artificial Sequence
  Synthetic Construct
gggctcacctaacctggtatcaaga

SEQ ID NO: 40978 - DNA, 22 bp, Artificial Sequence
  Synthetic Construct
ccacttggtgcagtgaggaaga

SEQ ID NO: 40979 - DNA, 21 bp, Artificial Sequence
  Synthetic Construct
ttcgcagggtctgggagtctt

SEQ ID NO: 40980 - DNA, 25 bp, Artificial Sequence
  Synthetic Construct
ccgagtccaactacactgtgccttt

SEQ ID NO: 40981 - DNA, 27 bp, Artificial Sequence
  Synthetic Construct
ggttgtgaatcagaaggctagtaggtt

SEQ ID NO: 40982 - DNA, 21 bp, Artificial Sequence
  Synthetic Construct
ccaggcaagtgggaggagtag

SEQ ID NO: 40983 - DNA, 25 bp, Artificial Sequence
  Synthetic Construct
gtgttagaactcagtggaggctaaa

SEQ ID NO: 40984 - DNA, 20 bp, Artificial Sequence
  Synthetic Construct
accccttgctgtcagtgaac

SEQ ID NO: 40985 - DNA, 22 bp, Artificial Sequence
  Synthetic Construct
ggatgagcttggatgcggttct

SEQ ID NO: 40986 - DNA, 24 bp, Artificial Sequence
  Synthetic Construct
cagtggttagattgtctcgcttct

SEQ ID NO: 40987 - DNA, 25 bp, Artificial Sequence
  Synthetic Construct
tgaggaaagtgagaacaggtgtcta

SEQ ID NO: 40988 - DNA, 26 bp, Artificial Sequence
  Synthetic Construct
cgcgagacagatctatgctcactttg

SEQ ID NO: 40989 - DNA, 22 bp, Artificial Sequence
  Synthetic Construct
aggaataatggggctgggattg

SEQ ID NO: 40990 - DNA, 21 bp, Artificial Sequence
  Synthetic Construct
ccatctggcagcctttcttct

SEQ ID NO: 40991 - DNA, 23 bp, Artificial Sequence
  Synthetic Construct
gtttctccagccttcacttccaa

SEQ ID NO: 40992 - DNA, 20 bp, Artificial Sequence
  Synthetic Construct
ctggccaggatggggttttt

SEQ ID NO: 40993 - DNA, 21 bp, Artificial Sequence
  Synthetic Construct
gggcggccagagaaaacatac

SEQ ID NO: 40994 - DNA, 25 bp, Artificial Sequence
  Synthetic Construct
gagaagaaggaatgaggggagaaca

SEQ ID NO: 40995 - DNA, 21 bp, Artificial Sequence
  Synthetic Construct
ttcacccctggtcaaggatct

SEQ ID NO: 40996 - DNA, 20 bp, Artificial Sequence
  Synthetic Construct
tgccaaagagggcctgaaga

SEQ ID NO: 40997 - DNA, 23 bp, Artificial Sequence
  Synthetic Construct
gcctagacgagctgatctgagta

SEQ ID NO: 40998 - DNA, 20 bp, Artificial Sequence
  Synthetic Construct
ttccagcatgggccagattg

SEQ ID NO: 40999 - DNA, 23 bp, Artificial Sequence
  Synthetic Construct
ccctgtcacagcttgcctctatc

SEQ ID NO: 41000 - DNA, 25 bp, Artificial Sequence
  Synthetic Construct
accaggatttgaagatatgccatga

SEQ ID NO: 41001 - DNA, 23 bp, Artificial Sequence
  Synthetic Construct
gccagaatcctggtagtgtgctt

SEQ ID NO: 41002 - DNA, 25 bp, Artificial Sequence
  Synthetic Construct
aggtattttgggacagacactgatt

SEQ ID NO: 41003 - DNA, 22 bp, Artificial Sequence
  Synthetic Construct
gagggtcaccagaatcgcaaac

SEQ ID NO: 41004 - DNA, 27 bp, Artificial Sequence
  Synthetic Construct
gaaccacttcaggtatcactagattgt

SEQ ID NO: 41005 - DNA, 23 bp, Artificial Sequence
  Synthetic Construct
tttccctggagcatatccacttg

SEQ ID NO: 41006 - DNA, 25 bp, Artificial Sequence
  Synthetic Construct
ggcaaaacatatgctgtcccaaatg

SEQ ID NO: 41007 - DNA, 24 bp, Artificial Sequence
  Synthetic Construct
gcaggtggaggagtactaggatca

SEQ ID NO: 41008 - DNA, 24 bp, Artificial Sequence
  Synthetic Construct
gcctgctgctaaggtttcttggtt

SEQ ID NO: 41009 - DNA, 21 bp, Artificial Sequence
  Synthetic Construct
gatgctgtctacggcttgtga

SEQ ID NO: 41010 - DNA, 20 bp, Artificial Sequence
  Synthetic Construct
agggagcaggccatggatgt

SEQ ID NO: 41011 - DNA, 21 bp, Artificial Sequence
  Synthetic Construct
aggctggacaaggggcatgta

SEQ ID NO: 41012 - DNA, 23 bp, Artificial Sequence
  Synthetic Construct
ggcagtatcagaaacccaagagt

SEQ ID NO: 41013 - DNA, 25 bp, Artificial Sequence
  Synthetic Construct
gggaagtttttcaaaaggccagttc

SEQ ID NO: 41014 - DNA, 20 bp, Artificial Sequence
  Synthetic Construct
tgccaagggcgtggtaagta

SEQ ID NO: 41015 - DNA, 22 bp, Artificial Sequence
  Synthetic Construct
gcccatgacagcttcattcagt

SEQ ID NO: 41016 - DNA, 22 bp, Artificial Sequence
  Synthetic Construct
gtagctcaaactgcaggggaaa

SEQ ID NO: 41017 - DNA, 19 bp, Artificial Sequence
  Synthetic Construct
aaccaagccccgcctgact

SEQ ID NO: 41018 - DNA, 23 bp, Artificial Sequence
  Synthetic Construct
gcccagcaaaggttgataacagt

SEQ ID NO: 41019 - DNA, 22 bp, Artificial Sequence
  Synthetic Construct
aggctacatgctccctggagtt

SEQ ID NO: 41020 - DNA, 20 bp, Artificial Sequence
  Synthetic Construct
cccggactcagccagacttg

SEQ ID NO: 41021 - DNA, 19 bp, Artificial Sequence
  Synthetic Construct
gggtgggcggaatcagcat

SEQ ID NO: 41022 - DNA, 24 bp, Artificial Sequence
  Synthetic Construct
ctgtcaatgtctacagcaggaagt

SEQ ID NO: 41023 - DNA, 21 bp, Artificial Sequence
  Synthetic Construct
accccagccatcacacccaaa

SEQ ID NO: 41024 - DNA, 23 bp, Artificial Sequence
  Synthetic Construct
gtctgtcctcacacctactgttc

SEQ ID NO: 41025 - DNA, 24 bp, Artificial Sequence
  Synthetic Construct
cagtctgctggcttcaagatgttt

SEQ ID NO: 41026 - DNA, 25 bp, Artificial Sequence
  Synthetic Construct
gctgggtggtaaagagaggttcctt

SEQ ID NO: 41027 - DNA, 25 bp, Artificial Sequence
  Synthetic Construct
caccgagttgaaaagcaatggaatc

SEQ ID NO: 41028 - DNA, 23 bp, Artificial Sequence
  Synthetic Construct
caaccacgtaagtgatcgtggaa

SEQ ID NO: 41029 - DNA, 24 bp, Artificial Sequence
  Synthetic Construct
caaaggactgaccacctagagtca

SEQ ID NO: 41030 - DNA, 23 bp, Artificial Sequence
  Synthetic Construct
ggagttctacagccacgttcttc

SEQ ID NO: 41031 - DNA, 25 bp, Artificial Sequence
  Synthetic Construct
tctgaatagtaaacgttgccaccta

SEQ ID NO: 41032 - DNA, 22 bp, Artificial Sequence
  Synthetic Construct
ggctggcttctcatcacccttt

SEQ ID NO: 41033 - DNA, 20 bp, Artificial Sequence
  Synthetic Construct
tggaggctgtcccagtatgt

SEQ ID NO: 41034 - DNA, 25 bp, Artificial Sequence
  Synthetic Construct
gaaaaaggcaaaagtccttgctcat

SEQ ID NO: 41035 - DNA, 25 bp, Artificial Sequence
  Synthetic Construct
cctgtaattccatttgctggtgact

SEQ ID NO: 41036 - DNA, 25 bp, Artificial Sequence
  Synthetic Construct
gtggtgtctcctgaagctgagtatc

SEQ ID NO: 41037 - DNA, 25 bp, Artificial Sequence
  Synthetic Construct
cctctcacaacttgcttggccttac

SEQ ID NO: 41038 - DNA, 19 bp, Artificial Sequence
  Synthetic Construct
ggcctctgagggagcaagt

SEQ ID NO: 41039 - DNA, 25 bp, Artificial Sequence
  Synthetic Construct
ctgtgtttttggaggaccggtttac

SEQ ID NO: 41040 - DNA, 20 bp, Artificial Sequence
  Synthetic Construct
ggccgagtctgtcattgcat

SEQ ID NO: 41041 - DNA, 22 bp, Artificial Sequence
  Synthetic Construct
aagcccctaccaaacaacactt

SEQ ID NO: 41042 - DNA, 20 bp, Artificial Sequence
  Synthetic Construct
acaggtgtgagccactgtga

SEQ ID NO: 41043 - DNA, 20 bp, Artificial Sequence
  Synthetic Construct
aggagggaccagagccgttt

SEQ ID NO: 41044 - DNA, 24 bp, Artificial Sequence
  Synthetic Construct
gccagtgtttgtccctaaggtaag

SEQ ID NO: 41045 - DNA, 21 bp, Artificial Sequence
  Synthetic Construct
gcctggcctttgcttttgctt

SEQ ID NO: 41046 - DNA, 21 bp, Artificial Sequence
  Synthetic Construct
ccagccctttcatcagcttgt

SEQ ID NO: 41047 - DNA, 24 bp, Artificial Sequence
  Synthetic Construct
gctcgaggctgtacagatgtttct

SEQ ID NO: 41048 - DNA, 21 bp, Artificial Sequence
  Synthetic Construct
agcctgtggagtgcctctgtt

SEQ ID NO: 41049 - DNA, 22 bp, Artificial Sequence
  Synthetic Construct
ggtggaagccagattgggcaaa

SEQ ID NO: 41050 - DNA, 19 bp, Artificial Sequence
  Synthetic Construct
gccagagctgcagcagaga

SEQ ID NO: 41051 - DNA, 27 bp, Artificial Sequence
  Synthetic Construct
ggcttatacttaaggcatctggacatc

SEQ ID NO: 41052 - DNA, 25 bp, Artificial Sequence
  Synthetic Construct
agttctacctgaagccaatgctatc

SEQ ID NO: 41053 - DNA, 22 bp, Artificial Sequence
  Synthetic Construct
aggcccttggcagccttaattc

SEQ ID NO: 41054 - DNA, 25 bp, Artificial Sequence
  Synthetic Construct
aggttaaaacaccgtaagaggttga

SEQ ID NO: 41055 - DNA, 23 bp, Artificial Sequence
  Synthetic Construct
cctgagtctcactctggctccta

SEQ ID NO: 41056 - DNA, 22 bp, Artificial Sequence
  Synthetic Construct
gccggggaaatctttcttcaca

SEQ ID NO: 41057 - DNA, 22 bp, Artificial Sequence
  Synthetic Construct
gcctatctctcaggtcggtctt

SEQ ID NO: 41058 - DNA, 21 bp, Artificial Sequence
  Synthetic Construct
aaggccatgggcgggagagtt

SEQ ID NO: 41059 - DNA, 23 bp, Artificial Sequence
  Synthetic Construct
cctcagaagggagggaacaccat

SEQ ID NO: 41060 - DNA, 22 bp, Artificial Sequence
  Synthetic Construct
aaactggcctaaaccacagtga

SEQ ID NO: 41061 - DNA, 23 bp, Artificial Sequence
  Synthetic Construct
ggcaccatgacatgaacgagact

SEQ ID NO: 41062 - DNA, 26 bp, Artificial Sequence
  Synthetic Construct
gtgacttcctgcagttaccaatctgt

SEQ ID NO: 41063 - DNA, 25 bp, Artificial Sequence
  Synthetic Construct
cccacaccttttctggaaagataga

SEQ ID NO: 41064 - DNA, 26 bp, Artificial Sequence
  Synthetic Construct
ccaaagacctcaccatagtggtttac

SEQ ID NO: 41065 - DNA, 21 bp, Artificial Sequence
  Synthetic Construct
ccccactaaacctcccagtga

SEQ ID NO: 41066 - DNA, 20 bp, Artificial Sequence
  Synthetic Construct
gccatcacagcttcctggtt

SEQ ID NO: 41067 - DNA, 20 bp, Artificial Sequence
  Synthetic Construct
ggctgctgtgtccagtgtgt

SEQ ID NO: 41068 - DNA, 22 bp, Artificial Sequence
  Synthetic Construct
ctgctcataaaccaggcagcat

SEQ ID NO: 41069 - DNA, 26 bp, Artificial Sequence
  Synthetic Construct
gactttctccccaaatggtagtgaac

SEQ ID NO: 41070 - DNA, 19 bp, Artificial Sequence
  Synthetic Construct
tcccctggctcttcccttt

SEQ ID NO: 41071 - DNA, 25 bp, Artificial Sequence
  Synthetic Construct
gcggaaggtactgtacagcatcaca

SEQ ID NO: 41072 - DNA, 25 bp, Artificial Sequence
  Synthetic Construct
cgaaccaaagatgtgtctccagtat

SEQ ID NO: 41073 - DNA, 20 bp, Artificial Sequence
  Synthetic Construct
ccgggagctaggaggagaga

SEQ ID NO: 41074 - DNA, 20 bp, Artificial Sequence
  Synthetic Construct
atgggaccagttgcggttag

SEQ ID NO: 41075 - DNA, 20 bp, Artificial Sequence
  Synthetic Construct
tcgcggagcccagaggttct

SEQ ID NO: 41076 - DNA, 23 bp, Artificial Sequence
  Synthetic Construct
ccctttgaccccagacaggtagt

SEQ ID NO: 41077 - DNA, 24 bp, Artificial Sequence
  Synthetic Construct
gcccaatttggctggaaagataat

SEQ ID NO: 41078 - DNA, 20 bp, Artificial Sequence
  Synthetic Construct
tgacagtggcggttgagaga

SEQ ID NO: 41079 - DNA, 20 bp, Artificial Sequence
  Synthetic Construct
gcaactgagggtgtggaagt

SEQ ID NO: 41080 - DNA, 23 bp, Artificial Sequence
  Synthetic Construct
catggaggtacactgccgtaaag

SEQ ID NO: 41081 - DNA, 21 bp, Artificial Sequence
  Synthetic Construct
ttccaggaaggccggggtttt

SEQ ID NO: 41082 - DNA, 24 bp, Artificial Sequence
  Synthetic Construct
gccatctcagggtcagtgactatc

SEQ ID NO: 41083 - DNA, 25 bp, Artificial Sequence
  Synthetic Construct
ccatctcctatgtccttggttgagt

SEQ ID NO: 41084 - DNA, 25 bp, Artificial Sequence
  Synthetic Construct
tctggtacccttcagtaatggatca

SEQ ID NO: 41085 - DNA, 22 bp, Artificial Sequence
  Synthetic Construct
gggaactggatttcaggacaca

SEQ ID NO: 41086 - DNA, 24 bp, Artificial Sequence
  Synthetic Construct
cactccacctccagtctcttgttc

SEQ ID NO: 41087 - DNA, 23 bp, Artificial Sequence
  Synthetic Construct
cagccgaacaaggatgaggatct

SEQ ID NO: 41088 - DNA, 22 bp, Artificial Sequence
  Synthetic Construct
gcggctctaacacttccagcaa

SEQ ID NO: 41089 - DNA, 22 bp, Artificial Sequence
  Synthetic Construct
gtgtcggttctctccagcgtta

SEQ ID NO: 41090 - DNA, 28 bp, Artificial Sequence
  Synthetic Construct
cctgtttgagtctaatcgttccctctct

SEQ ID NO: 41091 - DNA, 27 bp, Artificial Sequence
  Synthetic Construct
ggggagagaaaatgggaaagcaagtag

SEQ ID NO: 41092 - DNA, 24 bp, Artificial Sequence
  Synthetic Construct
ccttcaacaggatagcaccgtttc

SEQ ID NO: 41093 - DNA, 24 bp, Artificial Sequence
  Synthetic Construct
gcagatctttcactggaggagaca

SEQ ID NO: 41094 - DNA, 20 bp, Artificial Sequence
  Synthetic Construct
ttgcctccaggtgggactgt

SEQ ID NO: 41095 - DNA, 20 bp, Artificial Sequence
  Synthetic Construct
agcaccatccatcggtcaca

SEQ ID NO: 41096 - DNA, 21 bp, Artificial Sequence
  Synthetic Construct
tccctggggagaccctactca

SEQ ID NO: 41097 - DNA, 19 bp, Artificial Sequence
  Synthetic Construct
tctcacccgcaaggtggaa

SEQ ID NO: 41098 - DNA, 22 bp, Artificial Sequence
  Synthetic Construct
cataagcacccaagtgctgcta

SEQ ID NO: 41099 - DNA, 20 bp, Artificial Sequence
  Synthetic Construct
agctgggatgtggctgtttg

SEQ ID NO: 41100 - DNA, 25 bp, Artificial Sequence
  Synthetic Construct
gagacaaatgtaacagggtggtttg

SEQ ID NO: 41101 - DNA, 20 bp, Artificial Sequence
  Synthetic Construct
aaccatgccagcctgctcta

SEQ ID NO: 41102 - DNA, 23 bp, Artificial Sequence
  Synthetic Construct
ggggattgttgaaggtggtgtga

SEQ ID NO: 41103 - DNA, 20 bp, Artificial Sequence
  Synthetic Construct
agaaagggctggttggcatt

SEQ ID NO: 41104 - DNA, 20 bp, Artificial Sequence
  Synthetic Construct
gggacctcccctgtgtctgt

SEQ ID NO: 41105 - DNA, 20 bp, Artificial Sequence
  Synthetic Construct
ggtccagcacaccctgaagt

SEQ ID NO: 41106 - DNA, 21 bp, Artificial Sequence
  Synthetic Construct
ctggcatcgctcgaattcact

SEQ ID NO: 41107 - DNA, 19 bp, Artificial Sequence
  Synthetic Construct
tcgctggcccttcatccat

SEQ ID NO: 41108 - DNA, 24 bp, Artificial Sequence
  Synthetic Construct
cgaggaagacctgactcagaaatc

SEQ ID NO: 41109 - DNA, 19 bp, Artificial Sequence
  Synthetic Construct
acgcagacctggctgttca

SEQ ID NO: 41110 - DNA, 26 bp, Artificial Sequence
  Synthetic Construct
cagtttcttgtatctggcttctctgt

SEQ ID NO: 41111 - DNA, 20 bp, Artificial Sequence
  Synthetic Construct
agggtttggcttggctcttg

SEQ ID NO: 41112 - DNA, 25 bp, Artificial Sequence
  Synthetic Construct
cccagttacactcttgaccccatgt

SEQ ID NO: 41113 - DNA, 23 bp, Artificial Sequence
  Synthetic Construct
gcagagtgcatctgtgagacaac

SEQ ID NO: 41114 - DNA, 22 bp, Artificial Sequence
  Synthetic Construct
gcaggatttgcctgtgcagtga

SEQ ID NO: 41115 - DNA, 24 bp, Artificial Sequence
  Synthetic Construct
aggtgcttcgacagaagtacatag

SEQ ID NO: 41116 - DNA, 19 bp, Artificial Sequence
  Synthetic Construct
acagcgtggcatgctttct

SEQ ID NO: 41117 - DNA, 22 bp, Artificial Sequence
  Synthetic Construct
tctagaagcctccctcctcaca

SEQ ID NO: 41118 - DNA, 24 bp, Artificial Sequence
  Synthetic Construct
tctctgaaaaggaggcaaggaaac

SEQ ID NO: 41119 - DNA, 26 bp, Artificial Sequence
  Synthetic Construct
ctcattatcagttttcaggccacgtt

SEQ ID NO: 41120 - DNA, 29 bp, Artificial Sequence
  Synthetic Construct
gggtgaatgttgcaggcatggtataaaac

SEQ ID NO: 41121 - DNA, 22 bp, Artificial Sequence
  Synthetic Construct
tggaaacctccttaccctctgt

SEQ ID NO: 41122 - DNA, 25 bp, Artificial Sequence
  Synthetic Construct
ctggaaagaggtgagaaatgctgtt

SEQ ID NO: 41123 - DNA, 20 bp, Artificial Sequence
  Synthetic Construct
accagggcgcagatcacctt

SEQ ID NO: 41124 - DNA, 20 bp, Artificial Sequence
  Synthetic Construct
tcaggcggttgaaggaggaa

SEQ ID NO: 41125 - DNA, 19 bp, Artificial Sequence
  Synthetic Construct
ggcaaccaccacaccaaac

SEQ ID NO: 41126 - DNA, 26 bp, Artificial Sequence
  Synthetic Construct
gcagttggcttgattggatcgtgata

SEQ ID NO: 41127 - DNA, 22 bp, Artificial Sequence
  Synthetic Construct
gtagcccttgggttttggctta

SEQ ID NO: 41128 - DNA, 23 bp, Artificial Sequence
  Synthetic Construct
acaagtttggtgacaagggaaga

SEQ ID NO: 41129 - DNA, 20 bp, Artificial Sequence
  Synthetic Construct
tctgtgcctgtcctcccaat

SEQ ID NO: 41130 - DNA, 20 bp, Artificial Sequence
  Synthetic Construct
tggctcccacacctccatct

SEQ ID NO: 41131 - DNA, 23 bp, Artificial Sequence
  Synthetic Construct
ggctctgtgaataccaggagttt

SEQ ID NO: 41132 - DNA, 20 bp, Artificial Sequence
  Synthetic Construct
gggaaaggcagcatgtgtgt

SEQ ID NO: 41133 - DNA, 20 bp, Artificial Sequence
  Synthetic Construct
cagacgcctgaatgccaact

SEQ ID NO: 41134 - DNA, 25 bp, Artificial Sequence
  Synthetic Construct
agggtgtattgctttctccatttct

SEQ ID NO: 41135 - DNA, 19 bp, Artificial Sequence
  Synthetic Construct
aggtcccaggacccagaca

SEQ ID NO: 41136 - DNA, 20 bp, Artificial Sequence
  Synthetic Construct
atgctgggctcagacacact

SEQ ID NO: 41137 - DNA, 25 bp, Artificial Sequence
  Synthetic Construct
ggtgagtgctcagtttcacctctga

SEQ ID NO: 41138 - DNA, 25 bp, Artificial Sequence
  Synthetic Construct
cacatggtttctacagttgcctgtt

SEQ ID NO: 41139 - DNA, 20 bp, Artificial Sequence
  Synthetic Construct
gggctgtgtgagaaggacaa

SEQ ID NO: 41140 - DNA, 23 bp, Artificial Sequence
  Synthetic Construct
ggctgttagtgagaggccacttt

SEQ ID NO: 41141 - DNA, 22 bp, Artificial Sequence
  Synthetic Construct
ccaagcaggtagctgggagaaa

SEQ ID NO: 41142 - DNA, 24 bp, Artificial Sequence
  Synthetic Construct
tggaacaatgggatgaagatcgaa

SEQ ID NO: 41143 - DNA, 23 bp, Artificial Sequence
  Synthetic Construct
cctcaatgtatgccaacgggaaa

SEQ ID NO: 41144 - DNA, 22 bp, Artificial Sequence
  Synthetic Construct
ctgggagtgacttcctcacact

SEQ ID NO: 41145 - DNA, 26 bp, Artificial Sequence
  Synthetic Construct
cacactgtacaatagtggagccaaac

SEQ ID NO: 41146 - DNA, 21 bp, Artificial Sequence
  Synthetic Construct
agacagcagcaggctcagttg

SEQ ID NO: 41147 - DNA, 22 bp, Artificial Sequence
  Synthetic Construct
gaagacatgggcagagaagcaa

SEQ ID NO: 41148 - DNA, 25 bp, Artificial Sequence
  Synthetic Construct
acttccaaatgtgtttccagtctct

SEQ ID NO: 41149 - DNA, 20 bp, Artificial Sequence
  Synthetic Construct
acccacacagatgggctctt

SEQ ID NO: 41150 - DNA, 24 bp, Artificial Sequence
  Synthetic Construct
ctgtccagccttgattctttggaa

SEQ ID NO: 41151 - DNA, 23 bp, Artificial Sequence
  Synthetic Construct
tgtcgtgtttctccatgttccat

SEQ ID NO: 41152 - DNA, 25 bp, Artificial Sequence
  Synthetic Construct
gagtatctgtgtgccagtgtacttc

SEQ ID NO: 41153 - DNA, 21 bp, Artificial Sequence
  Synthetic Construct
gccttgagaccttgcgagtga

SEQ ID NO: 41154 - DNA, 22 bp, Artificial Sequence
  Synthetic Construct
ccaagatgaccacgtcctggaa

SEQ ID NO: 41155 - DNA, 23 bp, Artificial Sequence
  Synthetic Construct
gcagaactgtctgaccacccaaa

SEQ ID NO: 41156 - DNA, 23 bp, Artificial Sequence
  Synthetic Construct
tctgggaaccaaaacaagcacta

SEQ ID NO: 41157 - DNA, 24 bp, Artificial Sequence
  Synthetic Construct
ggtcccatacagaaggggatcttg

SEQ ID NO: 41158 - DNA, 25 bp, Artificial Sequence
  Synthetic Construct
gctgaaaccaagtcctgtagcatca

SEQ ID NO: 41159 - DNA, 22 bp, Artificial Sequence
  Synthetic Construct
gctgttgacacagtccctgcat

SEQ ID NO: 41160 - DNA, 24 bp, Artificial Sequence
  Synthetic Construct
agtttcagtctcacccagttcaag

SEQ ID NO: 41161 - DNA, 22 bp, Artificial Sequence
  Synthetic Construct
acgctatgtgctgtgactccta

SEQ ID NO: 41162 - DNA, 23 bp, Artificial Sequence
  Synthetic Construct
cggtttagagcatgtgggctttg

SEQ ID NO: 41163 - DNA, 24 bp, Artificial Sequence
  Synthetic Construct
cttcccatttgaagaggggattga

SEQ ID NO: 41164 - DNA, 22 bp, Artificial Sequence
  Synthetic Construct
gtgctggtacctgttgcctcta

SEQ ID NO: 41165 - DNA, 23 bp, Artificial Sequence
  Synthetic Construct
gctcatggtgtcaggggtagtga

SEQ ID NO: 41166 - DNA, 25 bp, Artificial Sequence
  Synthetic Construct
gccccttgaatattcctgtggacat

SEQ ID NO: 41167 - DNA, 21 bp, Artificial Sequence
  Synthetic Construct
ggtcaatgccagcagatgagt

SEQ ID NO: 41168 - DNA, 22 bp, Artificial Sequence
  Synthetic Construct
ggctaagtgtgggatgccaaga

SEQ ID NO: 41169 - DNA, 21 bp, Artificial Sequence
  Synthetic Construct
gtgcagcatcacagagcaatg

SEQ ID NO: 41170 - DNA, 24 bp, Artificial Sequence
  Synthetic Construct
gaggaaaaacagccacagggaatc

SEQ ID NO: 41171 - DNA, 23 bp, Artificial Sequence
  Synthetic Construct
ctttcaagacctacgtgctgact

SEQ ID NO: 41172 - DNA, 20 bp, Artificial Sequence
  Synthetic Construct
ccaggcaggtgccaacaaaa

SEQ ID NO: 41173 - DNA, 22 bp, Artificial Sequence
  Synthetic Construct
gtgcaattcagatggcctcttc

SEQ ID NO: 41174 - DNA, 24 bp, Artificial Sequence
  Synthetic Construct
tgcagaatcactcagcatgttcta

SEQ ID NO: 41175 - DNA, 20 bp, Artificial Sequence
  Synthetic Construct
ggggcctcgttttggagttg

SEQ ID NO: 41176 - DNA, 20 bp, Artificial Sequence
  Synthetic Construct
gcctgcgaaccctggaaatg

SEQ ID NO: 41177 - DNA, 24 bp, Artificial Sequence
  Synthetic Construct
agtcttggcttgagtgaaatggta

SEQ ID NO: 41178 - DNA, 22 bp, Artificial Sequence
  Synthetic Construct
aggggcagagaagcctagtgta

SEQ ID NO: 41179 - DNA, 22 bp, Artificial Sequence
  Synthetic Construct
tctttcaggatgggccctgtag

SEQ ID NO: 41180 - DNA, 19 bp, Artificial Sequence
  Synthetic Construct
ttgcaaagcccgggagtgt

SEQ ID NO: 41181 - DNA, 25 bp, Artificial Sequence
  Synthetic Construct
gaccatagatcccctctcctacttg

SEQ ID NO: 41182 - DNA, 24 bp, Artificial Sequence
  Synthetic Construct
ggacgaaggtggtagcagtacaga

SEQ ID NO: 41183 - DNA, 22 bp, Artificial Sequence
  Synthetic Construct
ccttcactcgggtttcctgcaa

SEQ ID NO: 41184 - DNA, 24 bp, Artificial Sequence
  Synthetic Construct
tgtgaagtacaaaccaagcacttc

SEQ ID NO: 41185 - DNA, 21 bp, Artificial Sequence
  Synthetic Construct
tcaccctgcccctctttctct

SEQ ID NO: 41186 - DNA, 21 bp, Artificial Sequence
  Synthetic Construct
gcactgcctcagctcctttca

SEQ ID NO: 41187 - DNA, 25 bp, Artificial Sequence
  Synthetic Construct
catctcctagagctggagactgtat

SEQ ID NO: 41188 - DNA, 22 bp, Artificial Sequence
  Synthetic Construct
tgacaccagatgcccctctctt

SEQ ID NO: 41189 - DNA, 22 bp, Artificial Sequence
  Synthetic Construct
catgtctgtacagcagcccttt

SEQ ID NO: 41190 - DNA, 22 bp, Artificial Sequence
  Synthetic Construct
ccacatccaaagagcagagctt

SEQ ID NO: 41191 - DNA, 26 bp, Artificial Sequence
  Synthetic Construct
gcaaaatataggatggcctcgggttt

SEQ ID NO: 41192 - DNA, 20 bp, Artificial Sequence
  Synthetic Construct
ttggggagcaagcaccttac

SEQ ID NO: 41193 - DNA, 22 bp, Artificial Sequence
  Synthetic Construct
cacaccacttctctgtgaccat

SEQ ID NO: 41194 - DNA, 20 bp, Artificial Sequence
  Synthetic Construct
taggtcggggagctgagaca

SEQ ID NO: 41195 - DNA, 20 bp, Artificial Sequence
  Synthetic Construct
aaaccagcccgtcacacttg

SEQ ID NO: 41196 - DNA, 22 bp, Artificial Sequence
  Synthetic Construct
ccccaaaccatcttcagctctt

SEQ ID NO: 41197 - DNA, 20 bp, Artificial Sequence
  Synthetic Construct
tttgggtcaggggtctcctt

SEQ ID NO: 41198 - DNA, 24 bp, Artificial Sequence
  Synthetic Construct
caggtgacaaaccttcctggatgt

SEQ ID NO: 41199 - DNA, 24 bp, Artificial Sequence
  Synthetic Construct
caataaaaccttttccgggtcaca

SEQ ID NO: 41200 - DNA, 22 bp, Artificial Sequence
  Synthetic Construct
actgaatgggtcccactgttac

SEQ ID NO: 41201 - DNA, 22 bp, Artificial Sequence
  Synthetic Construct
gctcagggtgtggagtcaaaca

SEQ ID NO: 41202 - DNA, 27 bp, Artificial Sequence
  Synthetic Construct
cgtgtcctttagaggatgaaaagaaac

SEQ ID NO: 41203 - DNA, 24 bp, Artificial Sequence
  Synthetic Construct
tccaatgaatgtcaatggggttgt

SEQ ID NO: 41204 - DNA, 23 bp, Artificial Sequence
  Synthetic Construct
ctggatttcaggggtctgctgta

SEQ ID NO: 41205 - DNA, 24 bp, Artificial Sequence
  Synthetic Construct
gctgttcacagtttctggaagaca

SEQ ID NO: 41206 - DNA, 20 bp, Artificial Sequence
  Synthetic Construct
tccagccattccctgcatca

SEQ ID NO: 41207 - DNA, 20 bp, Artificial Sequence
  Synthetic Construct
tgtcagtgtgggcaggcaat

SEQ ID NO: 41208 - DNA, 20 bp, Artificial Sequence
  Synthetic Construct
gtggggcccttctcttctct

SEQ ID NO: 41209 - DNA, 21 bp, Artificial Sequence
  Synthetic Construct
tggtaagggctaggccaccaa

SEQ ID NO: 41210 - DNA, 20 bp, Artificial Sequence
  Synthetic Construct
gcagctgttcccgtgactgt

SEQ ID NO: 41211 - DNA, 19 bp, Artificial Sequence
  Synthetic Construct
tgcctgaagccccatgaac

SEQ ID NO: 41212 - DNA, 19 bp, Artificial Sequence
  Synthetic Construct
ttgcataagggcccgcttt

SEQ ID NO: 41213 - DNA, 28 bp, Artificial Sequence
  Synthetic Construct
ggaacagaacaagagagtagttgtggat

SEQ ID NO: 41214 - DNA, 23 bp, Artificial Sequence
  Synthetic Construct
gcaacgcagcaatatatgctcaa

SEQ ID NO: 41215 - DNA, 22 bp, Artificial Sequence
  Synthetic Construct
caccaaccccaacctagacttc

SEQ ID NO: 41216 - DNA, 20 bp, Artificial Sequence
  Synthetic Construct
tacccttggggcatgcaaag

SEQ ID NO: 41217 - DNA, 20 bp, Artificial Sequence
  Synthetic Construct
gccagccttgcagagaaaca

SEQ ID NO: 41218 - DNA, 26 bp, Artificial Sequence
  Synthetic Construct
ccacagtccctaaatggggagtatca

SEQ ID NO: 41219 - DNA, 19 bp, Artificial Sequence
  Synthetic Construct
ggtgggctctgtgctgtgt

SEQ ID NO: 41220 - DNA, 19 bp, Artificial Sequence
  Synthetic Construct
ccaggtgcagagcggtgta

SEQ ID NO: 41221 - DNA, 19 bp, Artificial Sequence
  Synthetic Construct
aagcctggctggcgctgaa

SEQ ID NO: 41222 - DNA, 20 bp, Artificial Sequence
  Synthetic Construct
aggagccgggcattcagaga

SEQ ID NO: 41223 - DNA, 28 bp, Artificial Sequence
  Synthetic Construct
gaggatccctttcctgtaactaaagtgt

SEQ ID NO: 41224 - DNA, 25 bp, Artificial Sequence
  Synthetic Construct
gtgtataaagccagaccaacgatgt

SEQ ID NO: 41225 - DNA, 20 bp, Artificial Sequence
  Synthetic Construct
tggcaggacgtggtgtccat

SEQ ID NO: 41226 - DNA, 20 bp, Artificial Sequence
  Synthetic Construct
ccgcaacctctcggggattt

SEQ ID NO: 41227 - DNA, 20 bp, Artificial Sequence
  Synthetic Construct
ggaggccaccattccacgat

SEQ ID NO: 41228 - DNA, 20 bp, Artificial Sequence
  Synthetic Construct
gatgccaaccgatgcctttg

SEQ ID NO: 41229 - DNA, 25 bp, Artificial Sequence
  Synthetic Construct
gttatgaattgcaagaccccatgaa

SEQ ID NO: 41230 - DNA, 20 bp, Artificial Sequence
  Synthetic Construct
cagaggcagctgcaccattt

SEQ ID NO: 41231 - DNA, 20 bp, Artificial Sequence
  Synthetic Construct
tcagctgacagggccaaaac

SEQ ID NO: 41232 - DNA, 23 bp, Artificial Sequence
  Synthetic Construct
ctctcagagcccaaactcattgt

SEQ ID NO: 41233 - DNA, 20 bp, Artificial Sequence
  Synthetic Construct
tgggctgtggaaaggtcatc

SEQ ID NO: 41234 - DNA, 22 bp, Artificial Sequence
  Synthetic Construct
agcaacggaaggaactcacatc

SEQ ID NO: 41235 - DNA, 19 bp, Artificial Sequence
  Synthetic Construct
ccagttggccctgctgaaa

SEQ ID NO: 41236 - DNA, 19 bp, Artificial Sequence
  Synthetic Construct
tggccgtcagcgtccactt

SEQ ID NO: 41237 - DNA, 18 bp, Artificial Sequence
  Synthetic Construct
gcgtgtagcgcaggtagt

SEQ ID NO: 41238 - DNA, 22 bp, Artificial Sequence
  Synthetic Construct
ctccaggaagtttcccttgtgt

SEQ ID NO: 41239 - DNA, 22 bp, Artificial Sequence
  Synthetic Construct
cctcctgtcttggttggcttgt

SEQ ID NO: 41240 - DNA, 24 bp, Artificial Sequence
  Synthetic Construct
ccaccagtgcacttagtgatgctt

SEQ ID NO: 41241 - DNA, 21 bp, Artificial Sequence
  Synthetic Construct
gctgggacacaccttccgaat

SEQ ID NO: 41242 - DNA, 20 bp, Artificial Sequence
  Synthetic Construct
tgccgggtgctctgctagat

SEQ ID NO: 41243 - DNA, 27 bp, Artificial Sequence
  Synthetic Construct
cagttatttgtctgggaagaggtggat

SEQ ID NO: 41244 - DNA, 20 bp, Artificial Sequence
  Synthetic Construct
gagggagggagggaatgtga

SEQ ID NO: 41245 - DNA, 20 bp, Artificial Sequence
  Synthetic Construct
acccggcttcccagtgctta

SEQ ID NO: 41246 - DNA, 27 bp, Artificial Sequence
  Synthetic Construct
gtgaaagaaatctcagaggctttgact

SEQ ID NO: 41247 - DNA, 22 bp, Artificial Sequence
  Synthetic Construct
tcttcttgaggcccatgtcaac

SEQ ID NO: 41248 - DNA, 27 bp, Artificial Sequence
  Synthetic Construct
gccaacttccttttgttggatcctttc

SEQ ID NO: 41249 - DNA, 22 bp, Artificial Sequence
  Synthetic Construct
accaccttgcctcagaccctat

SEQ ID NO: 41250 - DNA, 26 bp, Artificial Sequence
  Synthetic Construct
ggtgaagcagcatcttagaggggtat

SEQ ID NO: 41251 - DNA, 19 bp, Artificial Sequence
  Synthetic Construct
ggtggcccgaactctccat

SEQ ID NO: 41252 - DNA, 20 bp, Artificial Sequence
  Synthetic Construct
ccgtggatgtgggctagttt

SEQ ID NO: 41253 - DNA, 20 bp, Artificial Sequence
  Synthetic Construct
tccacctgcgctggagtatg

SEQ ID NO: 41254 - DNA, 20 bp, Artificial Sequence
  Synthetic Construct
tgtacccagtgccgactgtt

SEQ ID NO: 41255 - DNA, 21 bp, Artificial Sequence
  Synthetic Construct
ccatggagaccactggaggtt

SEQ ID NO: 41256 - DNA, 25 bp, Artificial Sequence
  Synthetic Construct
tctaaaactacctgagccacagttg

SEQ ID NO: 41257 - DNA, 21 bp, Artificial Sequence
  Synthetic Construct
gccaggctcttgactcccaat

SEQ ID NO: 41258 - DNA, 23 bp, Artificial Sequence
  Synthetic Construct
gtcgtctgcctcgatgacttttc

SEQ ID NO: 41259 - DNA, 21 bp, Artificial Sequence
  Synthetic Construct
ggttgtggcatgggcatcatt

SEQ ID NO: 41260 - DNA, 18 bp, Artificial Sequence
  Synthetic Construct
acctgcgtccctgcagaa

SEQ ID NO: 41261 - DNA, 20 bp, Artificial Sequence
  Synthetic Construct
tgtcttgctgccacctgaga

SEQ ID NO: 41262 - DNA, 21 bp, Artificial Sequence
  Synthetic Construct
agcctctccagctgggcttat

SEQ ID NO: 41263 - DNA, 25 bp, Artificial Sequence
  Synthetic Construct
tggtgaggaataaagggagacaaac

SEQ ID NO: 41264 - DNA, 24 bp, Artificial Sequence
  Synthetic Construct
aagaagtcactggaaagcacattg

SEQ ID NO: 41265 - DNA, 19 bp, Artificial Sequence
  Synthetic Construct
tggtcccaggcccacacat

SEQ ID NO: 41266 - DNA, 24 bp, Artificial Sequence
  Synthetic Construct
acagtaatggcttgatctgctgtt

SEQ ID NO: 41267 - DNA, 23 bp, Artificial Sequence
  Synthetic Construct
accttcacaggatcatcccaaag

SEQ ID NO: 41268 - DNA, 21 bp, Artificial Sequence
  Synthetic Construct
tacggtgtccagtggggcatt

SEQ ID NO: 41269 - DNA, 22 bp, Artificial Sequence
  Synthetic Construct
gcctatcacttggaggcctttc

SEQ ID NO: 41270 - DNA, 21 bp, Artificial Sequence
  Synthetic Construct
ggcacgagacttggtgtgtga

SEQ ID NO: 41271 - DNA, 22 bp, Artificial Sequence
  Synthetic Construct
ctttgcaacccctccagagaag

SEQ ID NO: 41272 - DNA, 18 bp, Artificial Sequence
  Synthetic Construct
tgcgcacagagcgaaagt

SEQ ID NO: 41273 - DNA, 20 bp, Artificial Sequence
  Synthetic Construct
agcctctgggcacagtgaac

SEQ ID NO: 41274 - DNA, 23 bp, Artificial Sequence
  Synthetic Construct
gccatctctttactgaccagctt

SEQ ID NO: 41275 - DNA, 25 bp, Artificial Sequence
  Synthetic Construct
gctgttctttcccatacacgtcact

SEQ ID NO: 41276 - DNA, 20 bp, Artificial Sequence
  Synthetic Construct
tggaatccgtgaggccaaga

SEQ ID NO: 41277 - DNA, 23 bp, Artificial Sequence
  Synthetic Construct
ctgaaactgtgtggtagcagcaa

SEQ ID NO: 41278 - DNA, 19 bp, Artificial Sequence
  Synthetic Construct
acagggctggcacacacaa

SEQ ID NO: 41279 - DNA, 21 bp, Artificial Sequence
  Synthetic Construct
gggctcttagccttggaggat

SEQ ID NO: 41280 - DNA, 22 bp, Artificial Sequence
  Synthetic Construct
ccttggagctgctgggaaagtt

SEQ ID NO: 41281 - DNA, 19 bp, Artificial Sequence
  Synthetic Construct
agccccaccgttgtctgta

SEQ ID NO: 41282 - DNA, 22 bp, Artificial Sequence
  Synthetic Construct
caggtgtcatctctgtggcaat

SEQ ID NO: 41283 - DNA, 20 bp, Artificial Sequence
  Synthetic Construct
gagacaatgctgccgggaaa

SEQ ID NO: 41284 - DNA, 21 bp, Artificial Sequence
  Synthetic Construct
gctttgctccggcagtgatct

SEQ ID NO: 41285 - DNA, 20 bp, Artificial Sequence
  Synthetic Construct
tccaagcgcgcagactgtat

SEQ ID NO: 41286 - DNA, 25 bp, Artificial Sequence
  Synthetic Construct
cccattgaaaactctccctgctatg

SEQ ID NO: 41287 - DNA, 28 bp, Artificial Sequence
  Synthetic Construct
cacctgctggtgatatatgacttcaaac

SEQ ID NO: 41288 - DNA, 22 bp, Artificial Sequence
  Synthetic Construct
ccaggaaggagtctggtgttgt

SEQ ID NO: 41289 - DNA, 21 bp, Artificial Sequence
  Synthetic Construct
gcgactgtcacggacacttct

SEQ ID NO: 41290 - DNA, 22 bp, Artificial Sequence
  Synthetic Construct
ctcaccagaggcacatcgtttc

SEQ ID NO: 41291 - DNA, 25 bp, Artificial Sequence
  Synthetic Construct
cctggttctttctctccctcctgtt

SEQ ID NO: 41292 - DNA, 22 bp, Artificial Sequence
  Synthetic Construct
agctcaagggacagcccaaatc

SEQ ID NO: 41293 - DNA, 22 bp, Artificial Sequence
  Synthetic Construct
ggcaaaggcaggcagaaagcaa

SEQ ID NO: 41294 - DNA, 20 bp, Artificial Sequence
  Synthetic Construct
tccctgacagccgcctcaat

SEQ ID NO: 41295 - DNA, 24 bp, Artificial Sequence
  Synthetic Construct
gggactcacaaactgctattgttc

SEQ ID NO: 41296 - DNA, 22 bp, Artificial Sequence
  Synthetic Construct
gctctgccaagagctggcttta

SEQ ID NO: 41297 - DNA, 26 bp, Artificial Sequence
  Synthetic Construct
tccaacctctaggattttcctctaca

SEQ ID NO: 41298 - DNA, 20 bp, Artificial Sequence
  Synthetic Construct
gctggcaactgcttgtgaga

SEQ ID NO: 41299 - DNA, 20 bp, Artificial Sequence
  Synthetic Construct
aggctgcttggccatgttct

SEQ ID NO: 41300 - DNA, 25 bp, Artificial Sequence
  Synthetic Construct
cccttgaaaatacctggttgcttct

SEQ ID NO: 41301 - DNA, 20 bp, Artificial Sequence
  Synthetic Construct
gagaagaatgcccgctctgt

SEQ ID NO: 41302 - DNA, 27 bp, Artificial Sequence
  Synthetic Construct
cccagatggagctgaaaagaggaattg

SEQ ID NO: 41303 - DNA, 22 bp, Artificial Sequence
  Synthetic Construct
ggggtccagcactattctcttg

SEQ ID NO: 41304 - DNA, 22 bp, Artificial Sequence
  Synthetic Construct
cgaggttgtcggaagggacttt

SEQ ID NO: 41305 - DNA, 20 bp, Artificial Sequence
  Synthetic Construct
ccaaggactcccagcacctt

SEQ ID NO: 41306 - DNA, 20 bp, Artificial Sequence
  Synthetic Construct
aatgtcaggcagcccagaga

SEQ ID NO: 41307 - DNA, 20 bp, Artificial Sequence
  Synthetic Construct
aaccggtggatcctgctttc

SEQ ID NO: 41308 - DNA, 22 bp, Artificial Sequence
  Synthetic Construct
agtccctccctggagttctttg

SEQ ID NO: 41309 - DNA, 24 bp, Artificial Sequence
  Synthetic Construct
tggagaatttgttgtggtggtgtt

SEQ ID NO: 41310 - DNA, 25 bp, Artificial Sequence
  Synthetic Construct
aagttacatcttccaaaccccagat

SEQ ID NO: 41311 - DNA, 25 bp, Artificial Sequence
  Synthetic Construct
gacagaatccaaatcctgcccttag

SEQ ID NO: 41312 - DNA, 20 bp, Artificial Sequence
  Synthetic Construct
cgagggtgacccctgattga

SEQ ID NO: 41313 - DNA, 25 bp, Artificial Sequence
  Synthetic Construct
ccaactggtgtcttctgtctacttg

SEQ ID NO: 41314 - DNA, 24 bp, Artificial Sequence
  Synthetic Construct
gcttctgtccctcaggacctttga

SEQ ID NO: 41315 - DNA, 21 bp, Artificial Sequence
  Synthetic Construct
tccttctccagctgctgtttc

SEQ ID NO: 41316 - DNA, 22 bp, Artificial Sequence
  Synthetic Construct
ctctcttttcccaggtgtgtgt

SEQ ID NO: 41317 - DNA, 23 bp, Artificial Sequence
  Synthetic Construct
gggtagaggccatggagacaaac

SEQ ID NO: 41318 - DNA, 25 bp, Artificial Sequence
  Synthetic Construct
ccataagaaagaaggacctgtgtga

SEQ ID NO: 41319 - DNA, 24 bp, Artificial Sequence
  Synthetic Construct
gcccagctttggactggtctaagt

SEQ ID NO: 41320 - DNA, 20 bp, Artificial Sequence
  Synthetic Construct
tctgggtcagagcaggacaa

SEQ ID NO: 41321 - DNA, 22 bp, Artificial Sequence
  Synthetic Construct
cctgctgcttcggactgatttc

SEQ ID NO: 41322 - DNA, 22 bp, Artificial Sequence
  Synthetic Construct
cgttacacgcagtagcgagttg

SEQ ID NO: 41323 - DNA, 20 bp, Artificial Sequence
  Synthetic Construct
gcccaggaaccacagtgcaa

SEQ ID NO: 41324 - DNA, 21 bp, Artificial Sequence
  Synthetic Construct
cctacaagggtggctggtctt

SEQ ID NO: 41325 - DNA, 19 bp, Artificial Sequence
  Synthetic Construct
tgctgtggcactggcattt

SEQ ID NO: 41326 - DNA, 22 bp, Artificial Sequence
  Synthetic Construct
gctctaggcctcatgtccagaa

SEQ ID NO: 41327 - DNA, 27 bp, Artificial Sequence
  Synthetic Construct
tctcagaagaaggaaagaggagtatgt

SEQ ID NO: 41328 - DNA, 22 bp, Artificial Sequence
  Synthetic Construct
tcctgtgcgactctgcttctct

SEQ ID NO: 41329 - DNA, 21 bp, Artificial Sequence
  Synthetic Construct
atcgatggctccccggtcatt

SEQ ID NO: 41330 - DNA, 20 bp, Artificial Sequence
  Synthetic Construct
actgtcacatccggggctat

SEQ ID NO: 41331 - DNA, 23 bp, Artificial Sequence
  Synthetic Construct
gatcacactactgcctcttggaa

SEQ ID NO: 41332 - DNA, 21 bp, Artificial Sequence
  Synthetic Construct
acagagagcttcaccccgaaa

SEQ ID NO: 41333 - DNA, 25 bp, Artificial Sequence
  Synthetic Construct
tcccagattgtcagactccataagt

SEQ ID NO: 41334 - DNA, 18 bp, Artificial Sequence
  Synthetic Construct
gcgccaacaccagagcat

SEQ ID NO: 41335 - DNA, 22 bp, Artificial Sequence
  Synthetic Construct
gggtcacctgtacttgggtttg

SEQ ID NO: 41336 - DNA, 19 bp, Artificial Sequence
  Synthetic Construct
ggtgggtgcagcccaagat

SEQ ID NO: 41337 - DNA, 22 bp, Artificial Sequence
  Synthetic Construct
gggtctcagctggttcgtttca

SEQ ID NO: 41338 - DNA, 24 bp, Artificial Sequence
  Synthetic Construct
ggccctttcgtactaccacgtatc

SEQ ID NO: 41339 - DNA, 20 bp, Artificial Sequence
  Synthetic Construct
caccctgcctgcctctaaaa

SEQ ID NO: 41340 - DNA, 22 bp, Artificial Sequence
  Synthetic Construct
ttctgcttaaaccaggccaaga

SEQ ID NO: 41341 - DNA, 21 bp, Artificial Sequence
  Synthetic Construct
ggccacgaaatgcatgcttga

SEQ ID NO: 41342 - DNA, 20 bp, Artificial Sequence
  Synthetic Construct
gttccatccgctgtccagtt

SEQ ID NO: 41343 - DNA, 27 bp, Artificial Sequence
  Synthetic Construct
gtcaccagtaccttctataagccttga

SEQ ID NO: 41344 - DNA, 25 bp, Artificial Sequence
  Synthetic Construct
ggatgaaccccttctacaggtaaca

SEQ ID NO: 41345 - DNA, 22 bp, Artificial Sequence
  Synthetic Construct
accaaattcaacagcgcactac

SEQ ID NO: 41346 - DNA, 20 bp, Artificial Sequence
  Synthetic Construct
ccacacctcagtccctgtga

SEQ ID NO: 41347 - DNA, 24 bp, Artificial Sequence
  Synthetic Construct
gctctgcacttcatccttccttag

SEQ ID NO: 41348 - DNA, 22 bp, Artificial Sequence
  Synthetic Construct
gggccttcatgctgtgtcattg

SEQ ID NO: 41349 - DNA, 22 bp, Artificial Sequence
  Synthetic Construct
tctggagttcctgggacaaaac

SEQ ID NO: 41350 - DNA, 21 bp, Artificial Sequence
  Synthetic Construct
ggcagctggaagacagagtgt

SEQ ID NO: 41351 - DNA, 22 bp, Artificial Sequence
  Synthetic Construct
gcacaatcagcaactgggacaa

SEQ ID NO: 41352 - DNA, 21 bp, Artificial Sequence
  Synthetic Construct
tcctccactggactgcggaat

SEQ ID NO: 41353 - DNA, 23 bp, Artificial Sequence
  Synthetic Construct
cctgctctgcatttccactggtt

SEQ ID NO: 41354 - DNA, 23 bp, Artificial Sequence
  Synthetic Construct
tttcagggagtcatgggctattg

SEQ ID NO: 41355 - DNA, 21 bp, Artificial Sequence
  Synthetic Construct
atcctgtcggggtgggtgctt

SEQ ID NO: 41356 - DNA, 26 bp, Artificial Sequence
  Synthetic Construct
tgacctcatctattctggctgttaga

SEQ ID NO: 41357 - DNA, 21 bp, Artificial Sequence
  Synthetic Construct
caacactgcagcttggcctta

SEQ ID NO: 41358 - DNA, 25 bp, Artificial Sequence
  Synthetic Construct
tgatctagagaaaggggaaggctat

SEQ ID NO: 41359 - DNA, 21 bp, Artificial Sequence
  Synthetic Construct
agcctgcctatcacccatact

SEQ ID NO: 41360 - DNA, 23 bp, Artificial Sequence
  Synthetic Construct
ctccatggaaaccaacctctcaa

SEQ ID NO: 41361 - DNA, 20 bp, Artificial Sequence
  Synthetic Construct
tctggggctcaagctgttct

SEQ ID NO: 41362 - DNA, 26 bp, Artificial Sequence
  Synthetic Construct
gagagtgaggaaaaaccaagacctta

SEQ ID NO: 41363 - DNA, 24 bp, Artificial Sequence
  Synthetic Construct
gggctgtgcttccatcttgccata

SEQ ID NO: 41364 - DNA, 20 bp, Artificial Sequence
  Synthetic Construct
tctcacacacctggcctcaa

SEQ ID NO: 41365 - DNA, 22 bp, Artificial Sequence
  Synthetic Construct
ccagccttggtctgtcttgctt

SEQ ID NO: 41366 - DNA, 21 bp, Artificial Sequence
  Synthetic Construct
agcacctccaggtcacaaatc

SEQ ID NO: 41367 - DNA, 18 bp, Artificial Sequence
  Synthetic Construct
tccgggactgtgggcaaa

SEQ ID NO: 41368 - DNA, 22 bp, Artificial Sequence
  Synthetic Construct
ggtgtttctggagggctgacaa

SEQ ID NO: 41369 - DNA, 25 bp, Artificial Sequence
  Synthetic Construct
cttcatacacctccatttgctgagt

SEQ ID NO: 41370 - DNA, 25 bp, Artificial Sequence
  Synthetic Construct
ccaagttgccaaagaatgcctgact

SEQ ID NO: 41371 - DNA, 20 bp, Artificial Sequence
  Synthetic Construct
cctgctagtgctgcttggtt

SEQ ID NO: 41372 - DNA, 21 bp, Artificial Sequence
  Synthetic Construct
catgtgctttgcagggagtct

SEQ ID NO: 41373 - DNA, 22 bp, Artificial Sequence
  Synthetic Construct
tcacgggtctagcctctgtttc

SEQ ID NO: 41374 - DNA, 18 bp, Artificial Sequence
  Synthetic Construct
tggcctttgggcgtcaat

SEQ ID NO: 41375 - DNA, 23 bp, Artificial Sequence
  Synthetic Construct
cctagtaaggaggaacgggattg

SEQ ID NO: 41376 - DNA, 25 bp, Artificial Sequence
  Synthetic Construct
cagctcagaagtaagactcccagat

SEQ ID NO: 41377 - DNA, 21 bp, Artificial Sequence
  Synthetic Construct
gaggacagcactccaaggttt

SEQ ID NO: 41378 - DNA, 21 bp, Artificial Sequence
  Synthetic Construct
tgtagcacactgcaacagtca

SEQ ID NO: 41379 - DNA, 24 bp, Artificial Sequence
  Synthetic Construct
ctcactacatccacagtccaggaa

SEQ ID NO: 41380 - DNA, 25 bp, Artificial Sequence
  Synthetic Construct
tccttcagagatcagagaagctttg

SEQ ID NO: 41381 - DNA, 22 bp, Artificial Sequence
  Synthetic Construct
ggtgcctgaaagagccagtgtt

SEQ ID NO: 41382 - DNA, 25 bp, Artificial Sequence
  Synthetic Construct
gacatctgagttaactggcaccaaa

SEQ ID NO: 41383 - DNA, 23 bp, Artificial Sequence
  Synthetic Construct
cacacgacacacacatgaacttg

SEQ ID NO: 41384 - DNA, 24 bp, Artificial Sequence
  Synthetic Construct
ggcccacatcactttgggcaaaac

SEQ ID NO: 41385 - DNA, 21 bp, Artificial Sequence
  Synthetic Construct
atgcaggctgacctcccatct

SEQ ID NO: 41386 - DNA, 22 bp, Artificial Sequence
  Synthetic Construct
gaacaaatgcatgcagccaagt

SEQ ID NO: 41387 - DNA, 22 bp, Artificial Sequence
  Synthetic Construct
ccaccctgcagacctcttacat

SEQ ID NO: 41388 - DNA, 20 bp, Artificial Sequence
  Synthetic Construct
agggactggaagagcactgt

SEQ ID NO: 41389 - DNA, 24 bp, Artificial Sequence
  Synthetic Construct
atcaaagacctggcaagaatcaga

SEQ ID NO: 41390 - DNA, 19 bp, Artificial Sequence
  Synthetic Construct
tgctggcaccagggcctaa

SEQ ID NO: 41391 - DNA, 22 bp, Artificial Sequence
  Synthetic Construct
ccctcctgtctgtgagggagat

SEQ ID NO: 41392 - DNA, 19 bp, Artificial Sequence
  Synthetic Construct
agccacagccccatgacta

SEQ ID NO: 41393 - DNA, 20 bp, Artificial Sequence
  Synthetic Construct
cgcacgtctcaggttgtgaa

SEQ ID NO: 41394 - DNA, 24 bp, Artificial Sequence
  Synthetic Construct
gtcagtcccctctccctacaaatg

SEQ ID NO: 41395 - DNA, 21 bp, Artificial Sequence
  Synthetic Construct
cgccccacaacccggatatta

SEQ ID NO: 41396 - DNA, 27 bp, Artificial Sequence
  Synthetic Construct
gggtttgtgtgcatggaaagagaaatc

SEQ ID NO: 41397 - DNA, 21 bp, Artificial Sequence
  Synthetic Construct
gcagcatttcctggcagtgta

SEQ ID NO: 41398 - DNA, 20 bp, Artificial Sequence
  Synthetic Construct
agcaaggggagtgtgactga

SEQ ID NO: 41399 - DNA, 26 bp, Artificial Sequence
  Synthetic Construct
cagaaccaaatccatagcccaaaatg

SEQ ID NO: 41400 - DNA, 23 bp, Artificial Sequence
  Synthetic Construct
ctgatgcctcccctaaatgttct

SEQ ID NO: 41401 - DNA, 24 bp, Artificial Sequence
  Synthetic Construct
ggtactaaggggtaatgccgagta

SEQ ID NO: 41402 - DNA, 22 bp, Artificial Sequence
  Synthetic Construct
cctcacaccagagctgtccttt

SEQ ID NO: 41403 - DNA, 21 bp, Artificial Sequence
  Synthetic Construct
tcgggtcctgcctttctcttg

SEQ ID NO: 41404 - DNA, 21 bp, Artificial Sequence
  Synthetic Construct
gcaaacatcagctcccagtca

SEQ ID NO: 41405 - DNA, 24 bp, Artificial Sequence
  Synthetic Construct
gcatctctggttcttcccaagtca

SEQ ID NO: 41406 - DNA, 22 bp, Artificial Sequence
  Synthetic Construct
gacgctgatgtaacctggaagt

SEQ ID NO: 41407 - DNA, 26 bp, Artificial Sequence
  Synthetic Construct
tggtgtcattctaatctctggaggta

SEQ ID NO: 41408 - DNA, 25 bp, Artificial Sequence
  Synthetic Construct
caagggtatccccaagagatgttag

SEQ ID NO: 41409 - DNA, 23 bp, Artificial Sequence
  Synthetic Construct
gacttactagcggacaggtttca

SEQ ID NO: 41410 - DNA, 24 bp, Artificial Sequence
  Synthetic Construct
gctgtagacatgctcttggtgtct

SEQ ID NO: 41411 - DNA, 20 bp, Artificial Sequence
  Synthetic Construct
ggccagcgatccagagagat

SEQ ID NO: 41412 - DNA, 27 bp, Artificial Sequence
  Synthetic Construct
ctcaacagtgaagctgtgtatcctaag

SEQ ID NO: 41413 - DNA, 22 bp, Artificial Sequence
  Synthetic Construct
aatcccaggaggccctgaaatc

SEQ ID NO: 41414 - DNA, 22 bp, Artificial Sequence
  Synthetic Construct
ggctaaagcgacaggagcagat

SEQ ID NO: 41415 - DNA, 23 bp, Artificial Sequence
  Synthetic Construct
ctcaaatcctcctgtctgtggaa

SEQ ID NO: 41416 - DNA, 25 bp, Artificial Sequence
  Synthetic Construct
ggaaatacagggcctatggtagcaa

SEQ ID NO: 41417 - DNA, 20 bp, Artificial Sequence
  Synthetic Construct
cgagctctccggcgatgtaa

SEQ ID NO: 41418 - DNA, 24 bp, Artificial Sequence
  Synthetic Construct
gaggagggactatgaaggatgcta

SEQ ID NO: 41419 - DNA, 23 bp, Artificial Sequence
  Synthetic Construct
ctggaattacatgccaccacact

SEQ ID NO: 41420 - DNA, 27 bp, Artificial Sequence
  Synthetic Construct
ggctgcagaagttcatagcgttaaatc

SEQ ID NO: 41421 - DNA, 19 bp, Artificial Sequence
  Synthetic Construct
tttcgggtccaggcgaact

SEQ ID NO: 41422 - DNA, 21 bp, Artificial Sequence
  Synthetic Construct
ggagccagttggcatcacctt

SEQ ID NO: 41423 - DNA, 23 bp, Artificial Sequence
  Synthetic Construct
actaggaaggtaagcaggaggaa

SEQ ID NO: 41424 - DNA, 22 bp, Artificial Sequence
  Synthetic Construct
gctctctctgtacctgccaatc

SEQ ID NO: 41425 - DNA, 23 bp, Artificial Sequence
  Synthetic Construct
aatacgtaggctttgcaggtcat

SEQ ID NO: 41426 - DNA, 22 bp, Artificial Sequence
  Synthetic Construct
gcttgtcagtgatgggttgttg

SEQ ID NO: 41427 - DNA, 24 bp, Artificial Sequence
  Synthetic Construct
gatgttgttttgcaggggtaagaa

SEQ ID NO: 41428 - DNA, 23 bp, Artificial Sequence
  Synthetic Construct
actttagtggctcacaacggaaa

SEQ ID NO: 41429 - DNA, 24 bp, Artificial Sequence
  Synthetic Construct
acagacagggataagtcagcaaga

SEQ ID NO: 41430 - DNA, 22 bp, Artificial Sequence
  Synthetic Construct
gcagcagggcattaggacaaag

SEQ ID NO: 41431 - DNA, 26 bp, Artificial Sequence
  Synthetic Construct
gctaccaggttaatccctccctgtag

SEQ ID NO: 41432 - DNA, 23 bp, Artificial Sequence
  Synthetic Construct
gcatatcatgctggcttttggtt

SEQ ID NO: 41433 - DNA, 23 bp, Artificial Sequence
  Synthetic Construct
ggatcaatctgggaaggctgtga

SEQ ID NO: 41434 - DNA, 22 bp, Artificial Sequence
  Synthetic Construct
gcaacagcaatggcctggtaag

SEQ ID NO: 41435 - DNA, 30 bp, Artificial Sequence
  Synthetic Construct
cctgaaagtgaaaaacaggatggttgtatg

SEQ ID NO: 41436 - DNA, 21 bp, Artificial Sequence
  Synthetic Construct
acagctgagcacagtttgtct

SEQ ID NO: 41437 - DNA, 21 bp, Artificial Sequence
  Synthetic Construct
ttgtcagtccccacccacctt

SEQ ID NO: 41438 - DNA, 22 bp, Artificial Sequence
  Synthetic Construct
accgagcaacagggcttacttg

SEQ ID NO: 41439 - DNA, 22 bp, Artificial Sequence
  Synthetic Construct
tcactgcgatgagttggtttct

SEQ ID NO: 41440 - DNA, 23 bp, Artificial Sequence
  Synthetic Construct
attctaggcagaaaagggcaagt

SEQ ID NO: 41441 - DNA, 23 bp, Artificial Sequence
  Synthetic Construct
tcatgggatcttgcctagtggta

SEQ ID NO: 41442 - DNA, 26 bp, Artificial Sequence
  Synthetic Construct
cgtcttgtgttctctctaccctctgt

SEQ ID NO: 41443 - DNA, 24 bp, Artificial Sequence
  Synthetic Construct
ccatctctttcccacttgcccata

SEQ ID NO: 41444 - DNA, 25 bp, Artificial Sequence
  Synthetic Construct
gaaatgggaaacgagtgacctctat

SEQ ID NO: 41445 - DNA, 21 bp, Artificial Sequence
  Synthetic Construct
ctttggcctggtggtttgaga

SEQ ID NO: 41446 - DNA, 23 bp, Artificial Sequence
  Synthetic Construct
ccccaaaatggtatgaccaggat

SEQ ID NO: 41447 - DNA, 25 bp, Artificial Sequence
  Synthetic Construct
tgactccagttgtttgggagaatac

SEQ ID NO: 41448 - DNA, 20 bp, Artificial Sequence
  Synthetic Construct
ctcagcccatggtgagcatt

SEQ ID NO: 41449 - DNA, 23 bp, Artificial Sequence
  Synthetic Construct
caaggtcctacaagacccagttt

SEQ ID NO: 41450 - DNA, 20 bp, Artificial Sequence
  Synthetic Construct
gggactttgggctggactca

SEQ ID NO: 41451 - DNA, 23 bp, Artificial Sequence
  Synthetic Construct
gcccatctaggagctgatactct

SEQ ID NO: 41452 - DNA, 21 bp, Artificial Sequence
  Synthetic Construct
ccaccccgcattagtgtccat

SEQ ID NO: 41453 - DNA, 20 bp, Artificial Sequence
  Synthetic Construct
ttgcgctcagccaagtgaga

SEQ ID NO: 41454 - DNA, 25 bp, Artificial Sequence
  Synthetic Construct
cctggtgttaggatacagaccaact

SEQ ID NO: 41455 - DNA, 22 bp, Artificial Sequence
  Synthetic Construct
cagggtacgtgtagagcagact

SEQ ID NO: 41456 - DNA, 24 bp, Artificial Sequence
  Synthetic Construct
gcggaatctgaaagaaggccagat

SEQ ID NO: 41457 - DNA, 22 bp, Artificial Sequence
  Synthetic Construct
ccagaccgcagccaagattcta

SEQ ID NO: 41458 - DNA, 24 bp, Artificial Sequence
  Synthetic Construct
cattggtgcaatgctgtggtatag

SEQ ID NO: 41459 - DNA, 21 bp, Artificial Sequence
  Synthetic Construct
tctcggtgtcctcctgtttca

SEQ ID NO: 41460 - DNA, 20 bp, Artificial Sequence
  Synthetic Construct
gtgttcatggacgggtgtca

SEQ ID NO: 41461 - DNA, 20 bp, Artificial Sequence
  Synthetic Construct
aggggatccctggggagcta

SEQ ID NO: 41462 - DNA, 24 bp, Artificial Sequence
  Synthetic Construct
ctcccttacacagaaccccaattt

SEQ ID NO: 41463 - DNA, 26 bp, Artificial Sequence
  Synthetic Construct
gccccttaattgaatgaccccatact

SEQ ID NO: 41464 - DNA, 26 bp, Artificial Sequence
  Synthetic Construct
ggaaggaaaaatgcccagtcttctga

SEQ ID NO: 41465 - DNA, 26 bp, Artificial Sequence
  Synthetic Construct
gggtctatcacgtgttacttgggaat

SEQ ID NO: 41466 - DNA, 23 bp, Artificial Sequence
  Synthetic Construct
cctgcctcctaacggccaaatag

SEQ ID NO: 41467 - DNA, 21 bp, Artificial Sequence
  Synthetic Construct
gatgctgaggattggccttct

SEQ ID NO: 41468 - DNA, 25 bp, Artificial Sequence
  Synthetic Construct
ggcactggtgtagtgtttgagaaga

SEQ ID NO: 41469 - DNA, 23 bp, Artificial Sequence
  Synthetic Construct
gcaactctttccacacccagcaa

SEQ ID NO: 41470 - DNA, 20 bp, Artificial Sequence
  Synthetic Construct
aagtcggaggggccttcaca

SEQ ID NO: 41471 - DNA, 20 bp, Artificial Sequence
  Synthetic Construct
tgtgtggaggtgggtacaga

SEQ ID NO: 41472 - DNA, 22 bp, Artificial Sequence
  Synthetic Construct
gaccttcccttgtctgttggtt

SEQ ID NO: 41473 - DNA, 22 bp, Artificial Sequence
  Synthetic Construct
gagggtggaaggctccaataac

SEQ ID NO: 41474 - DNA, 21 bp, Artificial Sequence
  Synthetic Construct
aacctccatctgctcctgaga

SEQ ID NO: 41475 - DNA, 24 bp, Artificial Sequence
  Synthetic Construct
tcccagaagtactcatcaccattg

SEQ ID NO: 41476 - DNA, 19 bp, Artificial Sequence
  Synthetic Construct
tgaaggcagggcctgtttg

SEQ ID NO: 41477 - DNA, 22 bp, Artificial Sequence
  Synthetic Construct
gcctgtttccaccacactctct

SEQ ID NO: 41478 - DNA, 21 bp, Artificial Sequence
  Synthetic Construct
agcctcttcccttcactctgt

SEQ ID NO: 41479 - DNA, 22 bp, Artificial Sequence
  Synthetic Construct
aatggaccagccctgtcagtag

SEQ ID NO: 41480 - DNA, 20 bp, Artificial Sequence
  Synthetic Construct
cgcaacacagggagcgattt

SEQ ID NO: 41481 - DNA, 21 bp, Artificial Sequence
  Synthetic Construct
tcctgaccctacaccaacact

SEQ ID NO: 41482 - DNA, 20 bp, Artificial Sequence
  Synthetic Construct
acctggtgcccagcccatct

SEQ ID NO: 41483 - DNA, 21 bp, Artificial Sequence
  Synthetic Construct
tgacatgcttgctgactgcat

SEQ ID NO: 41484 - DNA, 22 bp, Artificial Sequence
  Synthetic Construct
agcccactctctgggtatgatg

SEQ ID NO: 41485 - DNA, 25 bp, Artificial Sequence
  Synthetic Construct
gaggcaattgatggcataacgaaac

SEQ ID NO: 41486 - DNA, 24 bp, Artificial Sequence
  Synthetic Construct
gtgccttaagtcccagtgatctgt

SEQ ID NO: 41487 - DNA, 24 bp, Artificial Sequence
  Synthetic Construct
gcttcctcaacctgatgtttcaag

SEQ ID NO: 41488 - DNA, 21 bp, Artificial Sequence
  Synthetic Construct
ggggatgagttctggcagtct

SEQ ID NO: 41489 - DNA, 22 bp, Artificial Sequence
  Synthetic Construct
agggtgtggagcctgttactct

SEQ ID NO: 41490 - DNA, 20 bp, Artificial Sequence
  Synthetic Construct
actccactcacccaggcttt

SEQ ID NO: 41491 - DNA, 24 bp, Artificial Sequence
  Synthetic Construct
ctttgcattcgtgccacaatagtt

SEQ ID NO: 41492 - DNA, 22 bp, Artificial Sequence
  Synthetic Construct
acacttgccgtcttcctgttac

SEQ ID NO: 41493 - DNA, 23 bp, Artificial Sequence
  Synthetic Construct
caagacctaaggcatgcaagtca

SEQ ID NO: 41494 - DNA, 26 bp, Artificial Sequence
  Synthetic Construct
cccttacaactccatcaagtaagaga

SEQ ID NO: 41495 - DNA, 20 bp, Artificial Sequence
  Synthetic Construct
cagtcggaaggcgagagaga

SEQ ID NO: 41496 - DNA, 27 bp, Artificial Sequence
  Synthetic Construct
cggttgatcccatggaattcagtctgt

SEQ ID NO: 41497 - DNA, 23 bp, Artificial Sequence
  Synthetic Construct
ccacatccttgcacgtccaaatc

SEQ ID NO: 41498 - DNA, 22 bp, Artificial Sequence
  Synthetic Construct
ccaactttgctccacactgcat

SEQ ID NO: 41499 - DNA, 22 bp, Artificial Sequence
  Synthetic Construct
ggagagacacctgactccctaa

SEQ ID NO: 41500 - DNA, 20 bp, Artificial Sequence
  Synthetic Construct
atccacttggccctccagaa

SEQ ID NO: 41501 - DNA, 23 bp, Artificial Sequence
  Synthetic Construct
gccatgtcccgtaccacttctac

SEQ ID NO: 41502 - DNA, 25 bp, Artificial Sequence
  Synthetic Construct
aatgaactaggagaagagggctaga

SEQ ID NO: 41503 - DNA, 18 bp, Artificial Sequence
  Synthetic Construct
gcgtaggccaccaacagt

SEQ ID NO: 41504 - DNA, 21 bp, Artificial Sequence
  Synthetic Construct
tggtgtttcttcccacacgtt

SEQ ID NO: 41505 - DNA, 20 bp, Artificial Sequence
  Synthetic Construct
ggcacatctggggcaaaaca

SEQ ID NO: 41506 - DNA, 20 bp, Artificial Sequence
  Synthetic Construct
caagcctgtgctgctagact

SEQ ID NO: 41507 - DNA, 26 bp, Artificial Sequence
  Synthetic Construct
gcatctccttaccctatacggcttca

SEQ ID NO: 41508 - DNA, 23 bp, Artificial Sequence
  Synthetic Construct
acccaattggcagttctcaactt

SEQ ID NO: 41509 - DNA, 20 bp, Artificial Sequence
  Synthetic Construct
cctggcatgaaaggggctaa

SEQ ID NO: 41510 - DNA, 19 bp, Artificial Sequence
  Synthetic Construct
agtgctgcagatgggcatt

SEQ ID NO: 41511 - DNA, 20 bp, Artificial Sequence
  Synthetic Construct
tacctccacagaggcagctt

SEQ ID NO: 41512 - DNA, 22 bp, Artificial Sequence
  Synthetic Construct
tttgctggcatactgggtttct

SEQ ID NO: 41513 - DNA, 22 bp, Artificial Sequence
  Synthetic Construct
gtcggtgggtttagggacagaa

SEQ ID NO: 41514 - DNA, 20 bp, Artificial Sequence
  Synthetic Construct
gctggagggaggctaagtga

SEQ ID NO: 41515 - DNA, 24 bp, Artificial Sequence
  Synthetic Construct
ccacttctgtaccgtctccaccaa

SEQ ID NO: 41516 - DNA, 23 bp, Artificial Sequence
  Synthetic Construct
ccctcaaaactagggtgaccaaa

SEQ ID NO: 41517 - DNA, 23 bp, Artificial Sequence
  Synthetic Construct
cccactagactccaagaggtttc

SEQ ID NO: 41518 - DNA, 22 bp, Artificial Sequence
  Synthetic Construct
ccattcgtagtcctgcctggat

SEQ ID NO: 41519 - DNA, 21 bp, Artificial Sequence
  Synthetic Construct
acctactgatggtgggcttca

SEQ ID NO: 41520 - DNA, 25 bp, Artificial Sequence
  Synthetic Construct
acaaaggaccacataagggagtatg

SEQ ID NO: 41521 - DNA, 20 bp, Artificial Sequence
  Synthetic Construct
ggcagcaggtctctgcaaaa

SEQ ID NO: 41522 - DNA, 21 bp, Artificial Sequence
  Synthetic Construct
ccccacaccccttgcattctt

SEQ ID NO: 41523 - DNA, 27 bp, Artificial Sequence
  Synthetic Construct
ggacacagataagttgccattctcgta

SEQ ID NO: 41524 - DNA, 20 bp, Artificial Sequence
  Synthetic Construct
tcagcagagtctggcactca

SEQ ID NO: 41525 - DNA, 20 bp, Artificial Sequence
  Synthetic Construct
aggctctgggctgggagaag

SEQ ID NO: 41526 - DNA, 23 bp, Artificial Sequence
  Synthetic Construct
gtggaagacacatggcctaatca

SEQ ID NO: 41527 - DNA, 20 bp, Artificial Sequence
  Synthetic Construct
tgacagaggccagtcactca

SEQ ID NO: 41528 - DNA, 25 bp, Artificial Sequence
  Synthetic Construct
ctctttgttgagaaacaggggaagt

SEQ ID NO: 41529 - DNA, 22 bp, Artificial Sequence
  Synthetic Construct
accaacaggtgaaaggtgactt

SEQ ID NO: 41530 - DNA, 23 bp, Artificial Sequence
  Synthetic Construct
catgctaagggcaacagcatttc

SEQ ID NO: 41531 - DNA, 20 bp, Artificial Sequence
  Synthetic Construct
aggagccacgaagcctgtga

SEQ ID NO: 41532 - DNA, 20 bp, Artificial Sequence
  Synthetic Construct
aggaggggtggctgccatga

SEQ ID NO: 41533 - DNA, 20 bp, Artificial Sequence
  Synthetic Construct
ttcggtgaaggacgcgcaaa

SEQ ID NO: 41534 - DNA, 27 bp, Artificial Sequence
  Synthetic Construct
cagaagataagttaaacggcagccaaa

SEQ ID NO: 41535 - DNA, 24 bp, Artificial Sequence
  Synthetic Construct
ggaaaggacacaattgccagaaga

SEQ ID NO: 41536 - DNA, 22 bp, Artificial Sequence
  Synthetic Construct
aggaggtcctgttgagctggta

SEQ ID NO: 41537 - DNA, 22 bp, Artificial Sequence
  Synthetic Construct
gtcccctcacaattgccctgaa

SEQ ID NO: 41538 - DNA, 22 bp, Artificial Sequence
  Synthetic Construct
cacactcaagacccgctgattc

SEQ ID NO: 41539 - DNA, 27 bp, Artificial Sequence
  Synthetic Construct
ccgttaaaatggccttatgcgtgtttg

SEQ ID NO: 41540 - DNA, 21 bp, Artificial Sequence
  Synthetic Construct
tctgtggccctaacacctaca

SEQ ID NO: 41541 - DNA, 25 bp, Artificial Sequence
  Synthetic Construct
tctactctcctgtggtttagcttct

SEQ ID NO: 41542 - DNA, 24 bp, Artificial Sequence
  Synthetic Construct
ggactggaagcaaaccagaaacta

SEQ ID NO: 41543 - DNA, 22 bp, Artificial Sequence
  Synthetic Construct
tgccaagtcattgctcttctgt

SEQ ID NO: 41544 - DNA, 20 bp, Artificial Sequence
  Synthetic Construct
tcaaagcctggccaccatca

SEQ ID NO: 41545 - DNA, 22 bp, Artificial Sequence
  Synthetic Construct
gtcccgtccctaaaaccatctt

SEQ ID NO: 41546 - DNA, 21 bp, Artificial Sequence
  Synthetic Construct
tgcccaacgatccctctgcat

SEQ ID NO: 41547 - DNA, 21 bp, Artificial Sequence
  Synthetic Construct
gaaggcagccaacagtgtagt

SEQ ID NO: 41548 - DNA, 20 bp, Artificial Sequence
  Synthetic Construct
cggttgcactttccctcctt

SEQ ID NO: 41549 - DNA, 19 bp, Artificial Sequence
  Synthetic Construct
accctcccttccccagact

SEQ ID NO: 41550 - DNA, 21 bp, Artificial Sequence
  Synthetic Construct
ccagcctctcagtcctgaaca

SEQ ID NO: 41551 - DNA, 20 bp, Artificial Sequence
  Synthetic Construct
gcttgtgaccaccacactga

SEQ ID NO: 41552 - DNA, 26 bp, Artificial Sequence
  Synthetic Construct
gcccatggagttacctaatggaccta

SEQ ID NO: 41553 - DNA, 21 bp, Artificial Sequence
  Synthetic Construct
gagcgggtcacttcacctttt

SEQ ID NO: 41554 - DNA, 22 bp, Artificial Sequence
  Synthetic Construct
cagcttcctgcccagtgataag

SEQ ID NO: 41555 - DNA, 23 bp, Artificial Sequence
  Synthetic Construct
gctcagtagctggggcttgtatg

SEQ ID NO: 41556 - DNA, 24 bp, Artificial Sequence
  Synthetic Construct
cagctagatttgtctccagctcaa

SEQ ID NO: 41557 - DNA, 21 bp, Artificial Sequence
  Synthetic Construct
gcctcctgttgggtcagagaa

SEQ ID NO: 41558 - DNA, 24 bp, Artificial Sequence
  Synthetic Construct
caaaagaaacactctgggctccaa

SEQ ID NO: 41559 - DNA, 23 bp, Artificial Sequence
  Synthetic Construct
ctgctgctttacccattctcagt

SEQ ID NO: 41560 - DNA, 25 bp, Artificial Sequence
  Synthetic Construct
cctgtctttttaaccctttgcatca

SEQ ID NO: 41561 - DNA, 23 bp, Artificial Sequence
  Synthetic Construct
ctgagatggtcactgtccctcaa

SEQ ID NO: 41562 - DNA, 26 bp, Artificial Sequence
  Synthetic Construct
gcctcacttccctttttctttcattc

SEQ ID NO: 41563 - DNA, 23 bp, Artificial Sequence
  Synthetic Construct
ggaacgatgtcacctctctggtt

SEQ ID NO: 41564 - DNA, 25 bp, Artificial Sequence
  Synthetic Construct
ttccttaaattggctggttgtcttg

SEQ ID NO: 41565 - DNA, 24 bp, Artificial Sequence
  Synthetic Construct
ttcattcaatcaggcccttgagaa

SEQ ID NO: 41566 - DNA, 21 bp, Artificial Sequence
  Synthetic Construct
cagccaatgggcatcagtttc

SEQ ID NO: 41567 - DNA, 21 bp, Artificial Sequence
  Synthetic Construct
cagaactgccctgtggaaaga

SEQ ID NO: 41568 - DNA, 20 bp, Artificial Sequence
  Synthetic Construct
tcctaccgcaccacactttc

SEQ ID NO: 41569 - DNA, 22 bp, Artificial Sequence
  Synthetic Construct
caggtctcaccccacaactact

SEQ ID NO: 41570 - DNA, 27 bp, Artificial Sequence
  Synthetic Construct
gcagaggattctaagccttgacaaact

SEQ ID NO: 41571 - DNA, 21 bp, Artificial Sequence
  Synthetic Construct
tctggaggggcagtagcatca

SEQ ID NO: 41572 - DNA, 24 bp, Artificial Sequence
  Synthetic Construct
cgtagcagatgcttagtggtcatc

SEQ ID NO: 41573 - DNA, 24 bp, Artificial Sequence
  Synthetic Construct
cacatggtcaagtccaaagtcaga

SEQ ID NO: 41574 - DNA, 23 bp, Artificial Sequence
  Synthetic Construct
cactgtgggctacacagaaccta

SEQ ID NO: 41575 - DNA, 22 bp, Artificial Sequence
  Synthetic Construct
gctagctatggggtgaggtcaa

SEQ ID NO: 41576 - DNA, 30 bp, Artificial Sequence
  Synthetic Construct
cccacttaactgagtatcggtagatctgaa

SEQ ID NO: 41577 - DNA, 25 bp, Artificial Sequence
  Synthetic Construct
gtgatggggcagagttaatccttgt

SEQ ID NO: 41578 - DNA, 26 bp, Artificial Sequence
  Synthetic Construct
gcttgccaaaggtcataatggagact

SEQ ID NO: 41579 - DNA, 19 bp, Artificial Sequence
  Synthetic Construct
gccaactggcagcatctga

SEQ ID NO: 41580 - DNA, 23 bp, Artificial Sequence
  Synthetic Construct
ggcaaaaggaaacctgtcacgta

SEQ ID NO: 41581 - DNA, 22 bp, Artificial Sequence
  Synthetic Construct
cgaacatggccgtgtgctttag

SEQ ID NO: 41582 - DNA, 24 bp, Artificial Sequence
  Synthetic Construct
gaccttgcaagaagatgagctgaa

SEQ ID NO: 41583 - DNA, 23 bp, Artificial Sequence
  Synthetic Construct
gacttgagatcagccgctcagat

SEQ ID NO: 41584 - DNA, 20 bp, Artificial Sequence
  Synthetic Construct
agggaaaggctgtggctgta

SEQ ID NO: 41585 - DNA, 22 bp, Artificial Sequence
  Synthetic Construct
ccacctagtaggcgttgacctt

SEQ ID NO: 41586 - DNA, 26 bp, Artificial Sequence
  Synthetic Construct
ctccacttgtgtactaaatcccaact

SEQ ID NO: 41587 - DNA, 25 bp, Artificial Sequence
  Synthetic Construct
cactctgtatggtagcgattctcaa

SEQ ID NO: 41588 - DNA, 22 bp, Artificial Sequence
  Synthetic Construct
tggagtcacctgtgaggtcaac

SEQ ID NO: 41589 - DNA, 21 bp, Artificial Sequence
  Synthetic Construct
gctcctttgttctcccaccaa

SEQ ID NO: 41590 - DNA, 20 bp, Artificial Sequence
  Synthetic Construct
gtcagccacagcaagccaat

SEQ ID NO: 41591 - DNA, 22 bp, Artificial Sequence
  Synthetic Construct
ccccattggtgccaagagcata

SEQ ID NO: 41592 - DNA, 23 bp, Artificial Sequence
  Synthetic Construct
tgcttgggaattacagcagttca

SEQ ID NO: 41593 - DNA, 21 bp, Artificial Sequence
  Synthetic Construct
ggttagggtgtcccagccata

SEQ ID NO: 41594 - DNA, 21 bp, Artificial Sequence
  Synthetic Construct
gtcccagtttgtgagcaggtt

SEQ ID NO: 41595 - DNA, 26 bp, Artificial Sequence
  Synthetic Construct
cccaaagcatttcattaccacctgaa

SEQ ID NO: 41596 - DNA, 24 bp, Artificial Sequence
  Synthetic Construct
aaggtgttcagaggagaaatgtgt

SEQ ID NO: 41597 - DNA, 22 bp, Artificial Sequence
  Synthetic Construct
cccatccttatgggctgtgaaa

SEQ ID NO: 41598 - DNA, 23 bp, Artificial Sequence
  Synthetic Construct
tggatataggccttgacggttga

SEQ ID NO: 41599 - DNA, 26 bp, Artificial Sequence
  Synthetic Construct
gagaacccttatttcttggtccacat

SEQ ID NO: 41600 - DNA, 22 bp, Artificial Sequence
  Synthetic Construct
aaagagaggaagggccctgaac

SEQ ID NO: 41601 - DNA, 24 bp, Artificial Sequence
  Synthetic Construct
atggagtgatctccctcatctaca

SEQ ID NO: 41602 - DNA, 22 bp, Artificial Sequence
  Synthetic Construct
caggatggctctgggcatctta

SEQ ID NO: 41603 - DNA, 23 bp, Artificial Sequence
  Synthetic Construct
cctcagatggggtgaggatgcta

SEQ ID NO: 41604 - DNA, 22 bp, Artificial Sequence
  Synthetic Construct
ccatttggtcctggccacattc

SEQ ID NO: 41605 - DNA, 22 bp, Artificial Sequence
  Synthetic Construct
ttctttgatccggggagagact

SEQ ID NO: 41606 - DNA, 27 bp, Artificial Sequence
  Synthetic Construct
cctggataactatcggttggctaattg

SEQ ID NO: 41607 - DNA, 21 bp, Artificial Sequence
  Synthetic Construct
gttcaggcatgtgacctgcta

SEQ ID NO: 41608 - DNA, 20 bp, Artificial Sequence
  Synthetic Construct
ggtgggaaacgggtgcagat

SEQ ID NO: 41609 - DNA, 22 bp, Artificial Sequence
  Synthetic Construct
ggtggagtctgtggttgtgaga

SEQ ID NO: 41610 - DNA, 20 bp, Artificial Sequence
  Synthetic Construct
accaccctcgcagacctttg

SEQ ID NO: 41611 - DNA, 25 bp, Artificial Sequence
  Synthetic Construct
tgaggtagggatccaaacttactct

SEQ ID NO: 41612 - DNA, 24 bp, Artificial Sequence
  Synthetic Construct
gtggctggcaaaggatgatataga

SEQ ID NO: 41613 - DNA, 20 bp, Artificial Sequence
  Synthetic Construct
gaggcagcaaagcctggaat

SEQ ID NO: 41614 - DNA, 23 bp, Artificial Sequence
  Synthetic Construct
cagccattcaatcaccctgtttc

SEQ ID NO: 41615 - DNA, 20 bp, Artificial Sequence
  Synthetic Construct
tggaatggtggtgccagttg

SEQ ID NO: 41616 - DNA, 21 bp, Artificial Sequence
  Synthetic Construct
tccagtttctgaggccagagt

SEQ ID NO: 41617 - DNA, 23 bp, Artificial Sequence
  Synthetic Construct
accttcacccaggggtatagaag

SEQ ID NO: 41618 - DNA, 26 bp, Artificial Sequence
  Synthetic Construct
catctccggatctccattttcttact

SEQ ID NO: 41619 - DNA, 23 bp, Artificial Sequence
  Synthetic Construct
ccacagtcccaaaagggctgtat

SEQ ID NO: 41620 - DNA, 23 bp, Artificial Sequence
  Synthetic Construct
ccatcgtgtccttgcacccttag

SEQ ID NO: 41621 - DNA, 22 bp, Artificial Sequence
  Synthetic Construct
cctgtgcactcaggccctatac

SEQ ID NO: 41622 - DNA, 22 bp, Artificial Sequence
  Synthetic Construct
cacacacaagtggaggacatga

SEQ ID NO: 41623 - DNA, 25 bp, Artificial Sequence
  Synthetic Construct
gaggcttaagggaaaagcctaacta

SEQ ID NO: 41624 - DNA, 25 bp, Artificial Sequence
  Synthetic Construct
gatgttagtgactgtgactggatct

SEQ ID NO: 41625 - DNA, 22 bp, Artificial Sequence
  Synthetic Construct
tcgaggttgagagcctgtgatg

SEQ ID NO: 41626 - DNA, 19 bp, Artificial Sequence
  Synthetic Construct
tgtgggccatcagcagctt

SEQ ID NO: 41627 - DNA, 25 bp, Artificial Sequence
  Synthetic Construct
ggttcaggaatctcctttgctcgaa

SEQ ID NO: 41628 - DNA, 24 bp, Artificial Sequence
  Synthetic Construct
cacatgattccctgttgcagtttg

SEQ ID NO: 41629 - DNA, 19 bp, Artificial Sequence
  Synthetic Construct
cctgtggcccagtgagtga

SEQ ID NO: 41630 - DNA, 18 bp, Artificial Sequence
  Synthetic Construct
ttgcacggaggccacaca

SEQ ID NO: 41631 - DNA, 26 bp, Artificial Sequence
  Synthetic Construct
ccatggactctattatcaacgcaaag

SEQ ID NO: 41632 - DNA, 23 bp, Artificial Sequence
  Synthetic Construct
ggcttataggcaacccagtcaca

SEQ ID NO: 41633 - DNA, 22 bp, Artificial Sequence
  Synthetic Construct
ggctggtccagtagttccagta

SEQ ID NO: 41634 - DNA, 22 bp, Artificial Sequence
  Synthetic Construct
ggtcctgtggatgcagcgattt

SEQ ID NO: 41635 - DNA, 20 bp, Artificial Sequence
  Synthetic Construct
agggcaaggcctcaacatga

SEQ ID NO: 41636 - DNA, 23 bp, Artificial Sequence
  Synthetic Construct
gagtgcatatccagctgttctct

SEQ ID NO: 41637 - DNA, 22 bp, Artificial Sequence
  Synthetic Construct
gtgggaactggatgggttggaa

SEQ ID NO: 41638 - DNA, 21 bp, Artificial Sequence
  Synthetic Construct
ttccgtggtaccgggtgttca

SEQ ID NO: 41639 - DNA, 23 bp, Artificial Sequence
  Synthetic Construct
aggtacttggctctgagagtctt

SEQ ID NO: 41640 - DNA, 26 bp, Artificial Sequence
  Synthetic Construct
caccttcttcctaaatccctccaatg

SEQ ID NO: 41641 - DNA, 23 bp, Artificial Sequence
  Synthetic Construct
ctgcccacataaagagagcatgt

SEQ ID NO: 41642 - DNA, 21 bp, Artificial Sequence
  Synthetic Construct
aaccaggtgccagtgctgcta

SEQ ID NO: 41643 - DNA, 22 bp, Artificial Sequence
  Synthetic Construct
agatgacttgccaaggaacaca

SEQ ID NO: 41644 - DNA, 23 bp, Artificial Sequence
  Synthetic Construct
gcccatgaaattgcacctcattc

SEQ ID NO: 41645 - DNA, 22 bp, Artificial Sequence
  Synthetic Construct
cgatgagcctctgcctactttc

SEQ ID NO: 41646 - DNA, 23 bp, Artificial Sequence
  Synthetic Construct
caccacacaggtcctcataccta

SEQ ID NO: 41647 - DNA, 24 bp, Artificial Sequence
  Synthetic Construct
gcagatgctcaggctctgtcaata

SEQ ID NO: 41648 - DNA, 19 bp, Artificial Sequence
  Synthetic Construct
ccagggctgagtgctgcat

SEQ ID NO: 41649 - DNA, 22 bp, Artificial Sequence
  Synthetic Construct
tgggatcagaaagcctgagttc

SEQ ID NO: 41650 - DNA, 22 bp, Artificial Sequence
  Synthetic Construct
gcccttcccacctctccaaata

SEQ ID NO: 41651 - DNA, 22 bp, Artificial Sequence
  Synthetic Construct
tccttgaggccatcctcttcat

SEQ ID NO: 41652 - DNA, 27 bp, Artificial Sequence
  Synthetic Construct
gggaataatggacagagagtcctcgaa

SEQ ID NO: 41653 - DNA, 22 bp, Artificial Sequence
  Synthetic Construct
cctgtggggagtagaagcaact

SEQ ID NO: 41654 - DNA, 23 bp, Artificial Sequence
  Synthetic Construct
gattgggttctggccaatgagat

SEQ ID NO: 41655 - DNA, 22 bp, Artificial Sequence
  Synthetic Construct
cggtgtcttggagagaggatga

SEQ ID NO: 41656 - DNA, 20 bp, Artificial Sequence
  Synthetic Construct
aggtgcagccttcgatgaga

SEQ ID NO: 41657 - DNA, 25 bp, Artificial Sequence
  Synthetic Construct
gaaacaggcatcataccaactctga

SEQ ID NO: 41658 - DNA, 20 bp, Artificial Sequence
  Synthetic Construct
gccaggcgtgttgctaggta

SEQ ID NO: 41659 - DNA, 26 bp, Artificial Sequence
  Synthetic Construct
gctgctaacaaaatcaggagcctttg

SEQ ID NO: 41660 - DNA, 24 bp, Artificial Sequence
  Synthetic Construct
ggacatttggggatgtgagtgtta

SEQ ID NO: 41661 - DNA, 21 bp, Artificial Sequence
  Synthetic Construct
atcctcccactctcgggtgaa

SEQ ID NO: 41662 - DNA, 21 bp, Artificial Sequence
  Synthetic Construct
gcaaccctgtgtgttccttct

SEQ ID NO: 41663 - DNA, 24 bp, Artificial Sequence
  Synthetic Construct
gtatctcccgtgaagagtcctact

SEQ ID NO: 41664 - DNA, 21 bp, Artificial Sequence
  Synthetic Construct
ttgctagccaaccacaaccat

SEQ ID NO: 41665 - DNA, 23 bp, Artificial Sequence
  Synthetic Construct
aacaccctgttatctgcttcaca

SEQ ID NO: 41666 - DNA, 25 bp, Artificial Sequence
  Synthetic Construct
ggaggattctaggtcagcagcaaga

SEQ ID NO: 41667 - DNA, 25 bp, Artificial Sequence
  Synthetic Construct
acacctctcagttatagagggacaa

SEQ ID NO: 41668 - DNA, 22 bp, Artificial Sequence
  Synthetic Construct
ggggttgcagtggttggtttca

SEQ ID NO: 41669 - DNA, 23 bp, Artificial Sequence
  Synthetic Construct
tgaactgcttgtctctggagttc

SEQ ID NO: 41670 - DNA, 22 bp, Artificial Sequence
  Synthetic Construct
ccaagggctccctacctacact

SEQ ID NO: 41671 - DNA, 23 bp, Artificial Sequence
  Synthetic Construct
ggccagagtgactcctttcaagt

SEQ ID NO: 41672 - DNA, 23 bp, Artificial Sequence
  Synthetic Construct
gacttagagttggcaccgtgttg

SEQ ID NO: 41673 - DNA, 25 bp, Artificial Sequence
  Synthetic Construct
ggagggaggaccacattgccaataa

SEQ ID NO: 41674 - DNA, 20 bp, Artificial Sequence
  Synthetic Construct
tgttggggagccaggagaca

SEQ ID NO: 41675 - DNA, 21 bp, Artificial Sequence
  Synthetic Construct
tgacttctcccctggctccaa

SEQ ID NO: 41676 - DNA, 23 bp, Artificial Sequence
  Synthetic Construct
gccatctggctcccttggtaatg

SEQ ID NO: 41677 - DNA, 25 bp, Artificial Sequence
  Synthetic Construct
cccattgtgcattacccaaagttag

SEQ ID NO: 41678 - DNA, 20 bp, Artificial Sequence
  Synthetic Construct
tggcccgtgagggtgaatta

SEQ ID NO: 41679 - DNA, 20 bp, Artificial Sequence
  Synthetic Construct
aaggagcaggggagggagta

SEQ ID NO: 41680 - DNA, 20 bp, Artificial Sequence
  Synthetic Construct
tggccggcattgggtctttt

SEQ ID NO: 41681 - DNA, 23 bp, Artificial Sequence
  Synthetic Construct
cgggtataacactgcacacaatc

SEQ ID NO: 41682 - DNA, 21 bp, Artificial Sequence
  Synthetic Construct
actccaggggagctgagactt

SEQ ID NO: 41683 - DNA, 20 bp, Artificial Sequence
  Synthetic Construct
aaggctggagctgggtgaga

SEQ ID NO: 41684 - DNA, 20 bp, Artificial Sequence
  Synthetic Construct
tcactctgccccaggctgtt

SEQ ID NO: 41685 - DNA, 22 bp, Artificial Sequence
  Synthetic Construct
agagttcacagtgtccctgcta

SEQ ID NO: 41686 - DNA, 25 bp, Artificial Sequence
  Synthetic Construct
ggaacccaccatcctttctcctaga

SEQ ID NO: 41687 - DNA, 22 bp, Artificial Sequence
  Synthetic Construct
gactcagaccctctcctgcata

SEQ ID NO: 41688 - DNA, 24 bp, Artificial Sequence
  Synthetic Construct
agcttaccttcccatctgtgtttg

SEQ ID NO: 41689 - DNA, 28 bp, Artificial Sequence
  Synthetic Construct
cacctatgtctgggcttagtagttaaag

SEQ ID NO: 41690 - DNA, 24 bp, Artificial Sequence
  Synthetic Construct
ggagaaacaatggcaacactggta

SEQ ID NO: 41691 - DNA, 19 bp, Artificial Sequence
  Synthetic Construct
gctgcagctctgggaagtt

SEQ ID NO: 41692 - DNA, 25 bp, Artificial Sequence
  Synthetic Construct
ccatgtctaatgaccagctcgattc

SEQ ID NO: 41693 - DNA, 24 bp, Artificial Sequence
  Synthetic Construct
ggcagccttcagtttagggccaat

SEQ ID NO: 41694 - DNA, 25 bp, Artificial Sequence
  Synthetic Construct
cacacttctgaagaaaggcaagcat

SEQ ID NO: 41695 - DNA, 19 bp, Artificial Sequence
  Synthetic Construct
ggacacccagcgtcgaaca

SEQ ID NO: 41696 - DNA, 21 bp, Artificial Sequence
  Synthetic Construct
aacgcaggcatccagggagat

SEQ ID NO: 41697 - DNA, 19 bp, Artificial Sequence
  Synthetic Construct
ccgactcccagcccaatca

SEQ ID NO: 41698 - DNA, 26 bp, Artificial Sequence
  Synthetic Construct
ggacaaacctacacctacagaactac

SEQ ID NO: 41699 - DNA, 23 bp, Artificial Sequence
  Synthetic Construct
tgcataggattgggctctctttc

SEQ ID NO: 41700 - DNA, 25 bp, Artificial Sequence
  Synthetic Construct
gggaatgcaaaatgatgcactggaa

SEQ ID NO: 41701 - DNA, 25 bp, Artificial Sequence
  Synthetic Construct
cccagatatgtgtggaggggtaaag

SEQ ID NO: 41702 - DNA, 30 bp, Artificial Sequence
  Synthetic Construct
ctggctccaaatatattgtcattcccattg

SEQ ID NO: 41703 - DNA, 27 bp, Artificial Sequence
  Synthetic Construct
gcagttttagcgataatccaacccaaa

SEQ ID NO: 41704 - DNA, 26 bp, Artificial Sequence
  Synthetic Construct
gggtgcacattcttcacaggttgtag

SEQ ID NO: 41705 - DNA, 19 bp, Artificial Sequence
  Synthetic Construct
ggggtagcatgccctgaac

SEQ ID NO: 41706 - DNA, 23 bp, Artificial Sequence
  Synthetic Construct
gcatctatggcctcatgggagtt

SEQ ID NO: 41707 - DNA, 20 bp, Artificial Sequence
  Synthetic Construct
ggccttgctctgtgtgacat

SEQ ID NO: 41708 - DNA, 23 bp, Artificial Sequence
  Synthetic Construct
tctcatctgtgccagatttggtt

SEQ ID NO: 41709 - DNA, 22 bp, Artificial Sequence
  Synthetic Construct
cttgaagcccagctcagtcatc

SEQ ID NO: 41710 - DNA, 21 bp, Artificial Sequence
  Synthetic Construct
ggagggcagtggctgaagtta

SEQ ID NO: 41711 - DNA, 25 bp, Artificial Sequence
  Synthetic Construct
gatattttgagtcagccagccattg

SEQ ID NO: 41712 - DNA, 22 bp, Artificial Sequence
  Synthetic Construct
ccaagaggcaggtggctgtaat

SEQ ID NO: 41713 - DNA, 25 bp, Artificial Sequence
  Synthetic Construct
catagaactgatctgtgtgggacaa

SEQ ID NO: 41714 - DNA, 20 bp, Artificial Sequence
  Synthetic Construct
gctgtagtggcgttgggaaa

SEQ ID NO: 41715 - DNA, 21 bp, Artificial Sequence
  Synthetic Construct
tttgctttggctgagggagaa

SEQ ID NO: 41716 - DNA, 20 bp, Artificial Sequence
  Synthetic Construct
tgtggaccaggtggaagtga

SEQ ID NO: 41717 - DNA, 20 bp, Artificial Sequence
  Synthetic Construct
gggtgcaagctttcctgttg

SEQ ID NO: 41718 - DNA, 22 bp, Artificial Sequence
  Synthetic Construct
cactgtctgagtgcctgctgtt

SEQ ID NO: 41719 - DNA, 30 bp, Artificial Sequence
  Synthetic Construct
ccaagacataaggaaatgaagacctactct

SEQ ID NO: 41720 - DNA, 21 bp, Artificial Sequence
  Synthetic Construct
ttgcctcctacctcccaggtt

SEQ ID NO: 41721 - DNA, 24 bp, Artificial Sequence
  Synthetic Construct
cccacactctcctctccactttgt

SEQ ID NO: 41722 - DNA, 22 bp, Artificial Sequence
  Synthetic Construct
gagaactccacaccgaccttga

SEQ ID NO: 41723 - DNA, 19 bp, Artificial Sequence
  Synthetic Construct
cccaaggtcagcccacaga

SEQ ID NO: 41724 - DNA, 27 bp, Artificial Sequence
  Synthetic Construct
gcctgacaaactagtccaaggaagata

SEQ ID NO: 41725 - DNA, 22 bp, Artificial Sequence
  Synthetic Construct
ccagaagatgtgggaggccttt

SEQ ID NO: 41726 - DNA, 24 bp, Artificial Sequence
  Synthetic Construct
gaccagtgtttaaaaggccaagtt

SEQ ID NO: 41727 - DNA, 23 bp, Artificial Sequence
  Synthetic Construct
ccagaagggacccctgaaatcat

SEQ ID NO: 41728 - DNA, 19 bp, Artificial Sequence
  Synthetic Construct
aacctggcaggcagagaca

SEQ ID NO: 41729 - DNA, 26 bp, Artificial Sequence
  Synthetic Construct
cacaagtcaaggtctcacttccaaac

SEQ ID NO: 41730 - DNA, 23 bp, Artificial Sequence
  Synthetic Construct
cctggggtcatctttacctcttc

SEQ ID NO: 41731 - DNA, 26 bp, Artificial Sequence
  Synthetic Construct
tctggctagctgtgttatctaggatt

SEQ ID NO: 41732 - DNA, 20 bp, Artificial Sequence
  Synthetic Construct
agctcgagacggccacattg

SEQ ID NO: 41733 - DNA, 20 bp, Artificial Sequence
  Synthetic Construct
cggctgccctacaaatgtct

SEQ ID NO: 41734 - DNA, 23 bp, Artificial Sequence
  Synthetic Construct
aacaagttcctcaactggggttt

SEQ ID NO: 41735 - DNA, 22 bp, Artificial Sequence
  Synthetic Construct
ggagggagcaggaagcatgtaa

SEQ ID NO: 41736 - DNA, 20 bp, Artificial Sequence
  Synthetic Construct
agctgggtgcacctgtggaa

SEQ ID NO: 41737 - DNA, 22 bp, Artificial Sequence
  Synthetic Construct
cctagccagaggggaattgtca

SEQ ID NO: 41738 - DNA, 24 bp, Artificial Sequence
  Synthetic Construct
acatgtttgaaatgggtggtgttc

SEQ ID NO: 41739 - DNA, 23 bp, Artificial Sequence
  Synthetic Construct
tgtgagtaactgagagggtctga

SEQ ID NO: 41740 - DNA, 24 bp, Artificial Sequence
  Synthetic Construct
ggtaccatcctgggacaccaatct

SEQ ID NO: 41741 - DNA, 19 bp, Artificial Sequence
  Synthetic Construct
attggcccacgctggtaga

SEQ ID NO: 41742 - DNA, 22 bp, Artificial Sequence
  Synthetic Construct
cactttggccagcagagagtca

SEQ ID NO: 41743 - DNA, 20 bp, Artificial Sequence
  Synthetic Construct
agtggaccagccagcatagt

SEQ ID NO: 41744 - DNA, 26 bp, Artificial Sequence
  Synthetic Construct
ggacaactcctctctcaaacacttag

SEQ ID NO: 41745 - DNA, 18 bp, Artificial Sequence
  Synthetic Construct
tcgtgctcagcgctccaa

SEQ ID NO: 41746 - DNA, 22 bp, Artificial Sequence
  Synthetic Construct
tggacctccgtgcctatcagtt

SEQ ID NO: 41747 - DNA, 22 bp, Artificial Sequence
  Synthetic Construct
tggtacctcggggtcctacagt

SEQ ID NO: 41748 - DNA, 21 bp, Artificial Sequence
  Synthetic Construct
caacctccctgacatgtgctt

SEQ ID NO: 41749 - DNA, 25 bp, Artificial Sequence
  Synthetic Construct
gtaaattagcctgtgccctaactga

SEQ ID NO: 41750 - DNA, 20 bp, Artificial Sequence
  Synthetic Construct
acatctgcacagcccctgta

SEQ ID NO: 41751 - DNA, 25 bp, Artificial Sequence
  Synthetic Construct
cacaccttcacatttcagtccttga

SEQ ID NO: 41752 - DNA, 25 bp, Artificial Sequence
  Synthetic Construct
gtcatttctcccactactccctatg

SEQ ID NO: 41753 - DNA, 19 bp, Artificial Sequence
  Synthetic Construct
tgtgtcccagtgcccttgt

SEQ ID NO: 41754 - DNA, 26 bp, Artificial Sequence
  Synthetic Construct
ggtgggacaccatcctccagtatatc

SEQ ID NO: 41755 - DNA, 22 bp, Artificial Sequence
  Synthetic Construct
ctgtctcttggcttccctgctt

SEQ ID NO: 41756 - DNA, 26 bp, Artificial Sequence
  Synthetic Construct
gcctaagcatggaactgacataggat

SEQ ID NO: 41757 - DNA, 24 bp, Artificial Sequence
  Synthetic Construct
tggctgacttacagagctgaattt

SEQ ID NO: 41758 - DNA, 27 bp, Artificial Sequence
  Synthetic Construct
ccttatctctgcaaatgtatgccttgt

SEQ ID NO: 41759 - DNA, 24 bp, Artificial Sequence
  Synthetic Construct
ccctctttgctacatgcccagaca

SEQ ID NO: 41760 - DNA, 20 bp, Artificial Sequence
  Synthetic Construct
gttcttgccatggggcttct

SEQ ID NO: 41761 - DNA, 20 bp, Artificial Sequence
  Synthetic Construct
gcagctgtgcctgacaaagt

SEQ ID NO: 41762 - DNA, 22 bp, Artificial Sequence
  Synthetic Construct
gcccaccaaagaggcaaggaaa

SEQ ID NO: 41763 - DNA, 22 bp, Artificial Sequence
  Synthetic Construct
cctacctcaaaggggtgcagtt

SEQ ID NO: 41764 - DNA, 22 bp, Artificial Sequence
  Synthetic Construct
gcacaaaggctgctgttacaag

SEQ ID NO: 41765 - DNA, 20 bp, Artificial Sequence
  Synthetic Construct
acctgtgcagagaccaggaa

SEQ ID NO: 41766 - DNA, 23 bp, Artificial Sequence
  Synthetic Construct
gacccatctaaaggcagtcactt

SEQ ID NO: 41767 - DNA, 19 bp, Artificial Sequence
  Synthetic Construct
accggactgagcggctact

SEQ ID NO: 41768 - DNA, 24 bp, Artificial Sequence
  Synthetic Construct
gccacctgcaatataaggatctga

SEQ ID NO: 41769 - DNA, 24 bp, Artificial Sequence
  Synthetic Construct
cctcaggctaatgctaggttcaag

SEQ ID NO: 41770 - DNA, 23 bp, Artificial Sequence
  Synthetic Construct
gtcattggagctggtctcaggaa

SEQ ID NO: 41771 - DNA, 19 bp, Artificial Sequence
  Synthetic Construct
cagctgttgtccccagtgt

SEQ ID NO: 41772 - DNA, 20 bp, Artificial Sequence
  Synthetic Construct
gtgaccagccctcaacaaga

SEQ ID NO: 41773 - DNA, 22 bp, Artificial Sequence
  Synthetic Construct
cataggggcagattcaccatgt

SEQ ID NO: 41774 - DNA, 23 bp, Artificial Sequence
  Synthetic Construct
aagggtaggagcagatcacctaa

SEQ ID NO: 41775 - DNA, 21 bp, Artificial Sequence
  Synthetic Construct
ccgagacatttggctgacagt

SEQ ID NO: 41776 - DNA, 25 bp, Artificial Sequence
  Synthetic Construct
acttctcctgaccaaggaaaacttc

SEQ ID NO: 41777 - DNA, 24 bp, Artificial Sequence
  Synthetic Construct
cctttttggactggcatgtgtcta

SEQ ID NO: 41778 - DNA, 25 bp, Artificial Sequence
  Synthetic Construct
ggagaagagaccatagggagcaaga

SEQ ID NO: 41779 - DNA, 24 bp, Artificial Sequence
  Synthetic Construct
gggtcagccttggtaagtgtccat

SEQ ID NO: 41780 - DNA, 25 bp, Artificial Sequence
  Synthetic Construct
catgcttattgtaaaagccctgcaa

SEQ ID NO: 41781 - DNA, 23 bp, Artificial Sequence
  Synthetic Construct
ggatgagggaaggtgttcagaga

SEQ ID NO: 41782 - DNA, 22 bp, Artificial Sequence
  Synthetic Construct
tggggaatcacctctccctcta

SEQ ID NO: 41783 - DNA, 28 bp, Artificial Sequence
  Synthetic Construct
ggagaaccaagagacagaagaaatccaa

SEQ ID NO: 41784 - DNA, 20 bp, Artificial Sequence
  Synthetic Construct
ccatggcacccaaccacttt

SEQ ID NO: 41785 - DNA, 22 bp, Artificial Sequence
  Synthetic Construct
cctcagggagtagcctagaagt

SEQ ID NO: 41786 - DNA, 25 bp, Artificial Sequence
  Synthetic Construct
caaaattaacttggccatgctgaga

SEQ ID NO: 41787 - DNA, 24 bp, Artificial Sequence
  Synthetic Construct
gtgaatgcttccagtggagttatg

SEQ ID NO: 41788 - DNA, 28 bp, Artificial Sequence
  Synthetic Construct
gagaaggtattagcaacacctgaagtag

SEQ ID NO: 41789 - DNA, 26 bp, Artificial Sequence
  Synthetic Construct
gaatactgaatccatggggatacctt

SEQ ID NO: 41790 - DNA, 19 bp, Artificial Sequence
  Synthetic Construct
tggtggtctggggcaagtt

SEQ ID NO: 41791 - DNA, 26 bp, Artificial Sequence
  Synthetic Construct
ccttgaaatccacatatgccagtcta

SEQ ID NO: 41792 - DNA, 24 bp, Artificial Sequence
  Synthetic Construct
ccctctgtctctgactgctaccaa

SEQ ID NO: 41793 - DNA, 19 bp, Artificial Sequence
  Synthetic Construct
agggtaggccctcccaagt

SEQ ID NO: 41794 - DNA, 22 bp, Artificial Sequence
  Synthetic Construct
gcctgaagaagccagagacgtt

SEQ ID NO: 41795 - DNA, 20 bp, Artificial Sequence
  Synthetic Construct
tggggtccagtcctttgtgt

SEQ ID NO: 41796 - DNA, 20 bp, Artificial Sequence
  Synthetic Construct
accctacccaacctggatgt

SEQ ID NO: 41797 - DNA, 23 bp, Artificial Sequence
  Synthetic Construct
gtctttatgggtgtggctctgaa

SEQ ID NO: 41798 - DNA, 26 bp, Artificial Sequence
  Synthetic Construct
cctgatctctacatattggcatgact

SEQ ID NO: 41799 - DNA, 25 bp, Artificial Sequence
  Synthetic Construct
gagggtaatagtagctcccttgcta

SEQ ID NO: 41800 - DNA, 25 bp, Artificial Sequence
  Synthetic Construct
ggaaaggttacaagacttgcacaga

SEQ ID NO: 41801 - DNA, 22 bp, Artificial Sequence
  Synthetic Construct
gagaactgggtgtcgaaaggat

SEQ ID NO: 41802 - DNA, 27 bp, Artificial Sequence
  Synthetic Construct
gtctgcaaagcctccaatatttacgaa

SEQ ID NO: 41803 - DNA, 29 bp, Artificial Sequence
  Synthetic Construct
gcaagcaagcaattaagaaggtaccaaac

SEQ ID NO: 41804 - DNA, 28 bp, Artificial Sequence
  Synthetic Construct
cccctagaaattagtcagacccctattc

SEQ ID NO: 41805 - DNA, 20 bp, Artificial Sequence
  Synthetic Construct
ccacatcccaaggacgtcaa

SEQ ID NO: 41806 - DNA, 20 bp, Artificial Sequence
  Synthetic Construct
tgcctgccactgagaccaaa

SEQ ID NO: 41807 - DNA, 20 bp, Artificial Sequence
  Synthetic Construct
ccaggccattaccgctgaga

SEQ ID NO: 41808 - DNA, 19 bp, Artificial Sequence
  Synthetic Construct
ttccatgccaccgggctaa

SEQ ID NO: 41809 - DNA, 26 bp, Artificial Sequence
  Synthetic Construct
cacaggtatgtttgaaagcaccaagt

SEQ ID NO: 41810 - DNA, 23 bp, Artificial Sequence
  Synthetic Construct
atttgagatgggtggatgcttca

SEQ ID NO: 41811 - DNA, 24 bp, Artificial Sequence
  Synthetic Construct
aagagaaagtcgctagtcacaagt

SEQ ID NO: 41812 - DNA, 20 bp, Artificial Sequence
  Synthetic Construct
gtcctgcacagctgttctct

SEQ ID NO: 41813 - DNA, 23 bp, Artificial Sequence
  Synthetic Construct
gccatctaactccctagctcaac

SEQ ID NO: 41814 - DNA, 25 bp, Artificial Sequence
  Synthetic Construct
gccacgtgtataccaaagggagata

SEQ ID NO: 41815 - DNA, 25 bp, Artificial Sequence
  Synthetic Construct
caagtcaaggttttgagtggtggta

SEQ ID NO: 41816 - DNA, 23 bp, Artificial Sequence
  Synthetic Construct
agatgcctaagctagaggcaaga

SEQ ID NO: 41817 - DNA, 24 bp, Artificial Sequence
  Synthetic Construct
ccaccctgagaaggttgggtaaga

SEQ ID NO: 41818 - DNA, 24 bp, Artificial Sequence
  Synthetic Construct
catggtactggattggcattgttt

SEQ ID NO: 41819 - DNA, 23 bp, Artificial Sequence
  Synthetic Construct
gacaaacagtggggtttttgtga

SEQ ID NO: 41820 - DNA, 24 bp, Artificial Sequence
  Synthetic Construct
ccactagggacaaaacttcactca

SEQ ID NO: 41821 - DNA, 25 bp, Artificial Sequence
  Synthetic Construct
cccatgcttttcactaggcaccata

SEQ ID NO: 41822 - DNA, 24 bp, Artificial Sequence
  Synthetic Construct
gactgagtaaacattcggggctaa

SEQ ID NO: 41823 - DNA, 20 bp, Artificial Sequence
  Synthetic Construct
gacatgagcgaggccattgt

SEQ ID NO: 41824 - DNA, 19 bp, Artificial Sequence
  Synthetic Construct
gctaggctcagggctgcat

SEQ ID NO: 41825 - DNA, 20 bp, Artificial Sequence
  Synthetic Construct
actggagcacaacccagcat

SEQ ID NO: 41826 - DNA, 23 bp, Artificial Sequence
  Synthetic Construct
tgtttgtaaaaccggggcaaaac

SEQ ID NO: 41827 - DNA, 25 bp, Artificial Sequence
  Synthetic Construct
gcctctctccaaggaatcagcattg

SEQ ID NO: 41828 - DNA, 21 bp, Artificial Sequence
  Synthetic Construct
cagcccatggcctaaaggatt

SEQ ID NO: 41829 - DNA, 26 bp, Artificial Sequence
  Synthetic Construct
gctccattcagtcaagagctccactt

SEQ ID NO: 41830 - DNA, 21 bp, Artificial Sequence
  Synthetic Construct
gagtcgcacacatgtccagtt

SEQ ID NO: 41831 - DNA, 22 bp, Artificial Sequence
  Synthetic Construct
ggtgctccctccaccttaaatg

SEQ ID NO: 41832 - DNA, 22 bp, Artificial Sequence
  Synthetic Construct
ttgtgcattttggggttggttt

SEQ ID NO: 41833 - DNA, 21 bp, Artificial Sequence
  Synthetic Construct
gtggaaatgcagcaccacact

SEQ ID NO: 41834 - DNA, 27 bp, Artificial Sequence
  Synthetic Construct
ggcctccatctataggtcagttacttg

SEQ ID NO: 41835 - DNA, 23 bp, Artificial Sequence
  Synthetic Construct
gtggctgaaagtgggagaactga

SEQ ID NO: 41836 - DNA, 25 bp, Artificial Sequence
  Synthetic Construct
gagagcccaaattcagaggtgttag

SEQ ID NO: 41837 - DNA, 21 bp, Artificial Sequence
  Synthetic Construct
aagtccaagggtccgcgaaga

SEQ ID NO: 41838 - DNA, 22 bp, Artificial Sequence
  Synthetic Construct
tcccttactgcagtggggtttg

SEQ ID NO: 41839 - DNA, 25 bp, Artificial Sequence
  Synthetic Construct
gtcctcgagctaagcttggtttttg

SEQ ID NO: 41840 - DNA, 21 bp, Artificial Sequence
  Synthetic Construct
tcggaggagtgctttgcatac

SEQ ID NO: 41841 - DNA, 20 bp, Artificial Sequence
  Synthetic Construct
agttacaggcggggtaccaa

SEQ ID NO: 41842 - DNA, 20 bp, Artificial Sequence
  Synthetic Construct
agggacagcgggtcaacatt

SEQ ID NO: 41843 - DNA, 24 bp, Artificial Sequence
  Synthetic Construct
gcaacgaaatgactgtgtttgaga

SEQ ID NO: 41844 - DNA, 22 bp, Artificial Sequence
  Synthetic Construct
gtgttgggaggtggtaccctta

SEQ ID NO: 41845 - DNA, 27 bp, Artificial Sequence
  Synthetic Construct
gccatttatgactcctagttgctgaag

SEQ ID NO: 41846 - DNA, 26 bp, Artificial Sequence
  Synthetic Construct
ggcttcaggaatggtcctataaccta

SEQ ID NO: 41847 - DNA, 24 bp, Artificial Sequence
  Synthetic Construct
gtgtttctcaaggggagagacatt

SEQ ID NO: 41848 - DNA, 22 bp, Artificial Sequence
  Synthetic Construct
ccgtgccaaacaaagggagaag

SEQ ID NO: 41849 - DNA, 22 bp, Artificial Sequence
  Synthetic Construct
tcccagaactcagtcccacgtt

SEQ ID NO: 41850 - DNA, 20 bp, Artificial Sequence
  Synthetic Construct
aggtggctgctgaactctca

SEQ ID NO: 41851 - DNA, 24 bp, Artificial Sequence
  Synthetic Construct
gaggtttgtgcagagaagctaatg

SEQ ID NO: 41852 - DNA, 24 bp, Artificial Sequence
  Synthetic Construct
tgtttaaggggtgagatggagtca

SEQ ID NO: 41853 - DNA, 24 bp, Artificial Sequence
  Synthetic Construct
tgaccaatcagttccactctttga

SEQ ID NO: 41854 - DNA, 20 bp, Artificial Sequence
  Synthetic Construct
ccacccggcaaccattttca

SEQ ID NO: 41855 - DNA, 22 bp, Artificial Sequence
  Synthetic Construct
gatgtgggcttgattggggaaa

SEQ ID NO: 41856 - DNA, 24 bp, Artificial Sequence
  Synthetic Construct
gcacttgaccctggttatcaggaa

SEQ ID NO: 41857 - DNA, 20 bp, Artificial Sequence
  Synthetic Construct
tggtggatgacggagcaact

SEQ ID NO: 41858 - DNA, 18 bp, Artificial Sequence
  Synthetic Construct
tggccagagccaggtaca

SEQ ID NO: 41859 - DNA, 22 bp, Artificial Sequence
  Synthetic Construct
aggcctggaggggtttaggaat

SEQ ID NO: 41860 - DNA, 23 bp, Artificial Sequence
  Synthetic Construct
gctcttgacttccccttcctaca

SEQ ID NO: 41861 - DNA, 20 bp, Artificial Sequence
  Synthetic Construct
acagtcacacaggccactct

SEQ ID NO: 41862 - DNA, 22 bp, Artificial Sequence
  Synthetic Construct
agctaactcatgtggctgttgt

SEQ ID NO: 41863 - DNA, 23 bp, Artificial Sequence
  Synthetic Construct
ctggtaggaaggcctgcttcaaa

SEQ ID NO: 41864 - DNA, 25 bp, Artificial Sequence
  Synthetic Construct
gctgttgttcaatggctctcagcta

SEQ ID NO: 41865 - DNA, 23 bp, Artificial Sequence
  Synthetic Construct
cggcacttgcagtttggtgaatg

SEQ ID NO: 41866 - DNA, 26 bp, Artificial Sequence
  Synthetic Construct
ctctaggttgtcttatagctgccatt

SEQ ID NO: 41867 - DNA, 21 bp, Artificial Sequence
  Synthetic Construct
gctctgccccaggtcttttca

SEQ ID NO: 41868 - DNA, 24 bp, Artificial Sequence
  Synthetic Construct
gcttctgccctttagaaagcttga

SEQ ID NO: 41869 - DNA, 18 bp, Artificial Sequence
  Synthetic Construct
cctgcccactgcaagtca

SEQ ID NO: 41870 - DNA, 23 bp, Artificial Sequence
  Synthetic Construct
gttaaacacacggcagtcttcaa

SEQ ID NO: 41871 - DNA, 20 bp, Artificial Sequence
  Synthetic Construct
tgtacgatgggtgggtgctt

SEQ ID NO: 41872 - DNA, 23 bp, Artificial Sequence
  Synthetic Construct
gccagtgtaacagatgcaacctt

SEQ ID NO: 41873 - DNA, 24 bp, Artificial Sequence
  Synthetic Construct
ctgttgccagtgatactggaagtt

SEQ ID NO: 41874 - DNA, 24 bp, Artificial Sequence
  Synthetic Construct
gcagaggcaagagtaaaggggaat

SEQ ID NO: 41875 - DNA, 22 bp, Artificial Sequence
  Synthetic Construct
gcttcctggatgcaagccactt

SEQ ID NO: 41876 - DNA, 25 bp, Artificial Sequence
  Synthetic Construct
ggaatgaagcttctgtgtgaaggat

SEQ ID NO: 41877 - DNA, 22 bp, Artificial Sequence
  Synthetic Construct
cgtgttagcagagaagggaact

SEQ ID NO: 41878 - DNA, 26 bp, Artificial Sequence
  Synthetic Construct
cccacgaccaataacagtatggatca

SEQ ID NO: 41879 - DNA, 24 bp, Artificial Sequence
  Synthetic Construct
ggtgtggtaggtatcacagcaaca

SEQ ID NO: 41880 - DNA, 25 bp, Artificial Sequence
  Synthetic Construct
tccctcaagtttgacatctgttgtt

SEQ ID NO: 41881 - DNA, 20 bp, Artificial Sequence
  Synthetic Construct
tgatctgcctctgcccatct

SEQ ID NO: 41882 - DNA, 20 bp, Artificial Sequence
  Synthetic Construct
gagccatctgctgctgaagt

SEQ ID NO: 41883 - DNA, 20 bp, Artificial Sequence
  Synthetic Construct
ctgctgcaccaccaactact

SEQ ID NO: 41884 - DNA, 20 bp, Artificial Sequence
  Synthetic Construct
acaaggtgtccccagtgtgt

SEQ ID NO: 41885 - DNA, 22 bp, Artificial Sequence
  Synthetic Construct
acccggatcagtttgactgtct

SEQ ID NO: 41886 - DNA, 20 bp, Artificial Sequence
  Synthetic Construct
actctgggcacatggagcaa

SEQ ID NO: 41887 - DNA, 20 bp, Artificial Sequence
  Synthetic Construct
cattctggagccagggcatt

SEQ ID NO: 41888 - DNA, 25 bp, Artificial Sequence
  Synthetic Construct
gctgccaaaagcaccatttggtttc

SEQ ID NO: 41889 - DNA, 22 bp, Artificial Sequence
  Synthetic Construct
ggggtggtggttaggaagtgaa

SEQ ID NO: 41890 - DNA, 21 bp, Artificial Sequence
  Synthetic Construct
agtccaagcccagggaaatct

SEQ ID NO: 41891 - DNA, 30 bp, Artificial Sequence
  Synthetic Construct
ggtctccagataagtccaagataagaagta

SEQ ID NO: 41892 - DNA, 24 bp, Artificial Sequence
  Synthetic Construct
catctccacccttgttgttactga

SEQ ID NO: 41893 - DNA, 25 bp, Artificial Sequence
  Synthetic Construct
gccttctttctgggtacataagtca

SEQ ID NO: 41894 - DNA, 23 bp, Artificial Sequence
  Synthetic Construct
agtggagcatggattttcacaca

SEQ ID NO: 41895 - DNA, 20 bp, Artificial Sequence
  Synthetic Construct
tgcagtgggcactgatgcta

SEQ ID NO: 41896 - DNA, 22 bp, Artificial Sequence
  Synthetic Construct
ggcagtccacatgtcaggatca

SEQ ID NO: 41897 - DNA, 21 bp, Artificial Sequence
  Synthetic Construct
gcccagacaagctgactctgt

SEQ ID NO: 41898 - DNA, 22 bp, Artificial Sequence
  Synthetic Construct
gggtcaggtgatggtgttttct

SEQ ID NO: 41899 - DNA, 23 bp, Artificial Sequence
  Synthetic Construct
tgaaaccaagctcacctctcttg

SEQ ID NO: 41900 - DNA, 22 bp, Artificial Sequence
  Synthetic Construct
gactgaacggtagagccctttg

SEQ ID NO: 41901 - DNA, 24 bp, Artificial Sequence
  Synthetic Construct
ccaaaaccaatctggtggctcttt

SEQ ID NO: 41902 - DNA, 20 bp, Artificial Sequence
  Synthetic Construct
tgtgcctggccaaggttagt

SEQ ID NO: 41903 - DNA, 24 bp, Artificial Sequence
  Synthetic Construct
ctgtcagctcaaatctcaggaaga

SEQ ID NO: 41904 - DNA, 21 bp, Artificial Sequence
  Synthetic Construct
tgggaggtagaacctgcaaca

SEQ ID NO: 41905 - DNA, 23 bp, Artificial Sequence
  Synthetic Construct
ctggctccccattgactactttg

SEQ ID NO: 41906 - DNA, 20 bp, Artificial Sequence
  Synthetic Construct
ggcaagcaggcttcatgcta

SEQ ID NO: 41907 - DNA, 22 bp, Artificial Sequence
  Synthetic Construct
tggatttcccactagccactga

SEQ ID NO: 41908 - DNA, 23 bp, Artificial Sequence
  Synthetic Construct
gagtcatgtgtcagctggttttg

SEQ ID NO: 41909 - DNA, 22 bp, Artificial Sequence
  Synthetic Construct
cctgctgcacaatagggcaatc

SEQ ID NO: 41910 - DNA, 22 bp, Artificial Sequence
  Synthetic Construct
ccccaggttgcttctgatcctt

SEQ ID NO: 41911 - DNA, 20 bp, Artificial Sequence
  Synthetic Construct
tctgtgacgtgctccagttc

SEQ ID NO: 41912 - DNA, 21 bp, Artificial Sequence
  Synthetic Construct
cctgccctgatgccacctatg

SEQ ID NO: 41913 - DNA, 19 bp, Artificial Sequence
  Synthetic Construct
aagccaggcagggcagata

SEQ ID NO: 41914 - DNA, 27 bp, Artificial Sequence
  Synthetic Construct
ctgacactggcaaattcctgaatatct

SEQ ID NO: 41915 - DNA, 20 bp, Artificial Sequence
  Synthetic Construct
tccagcaggacaagcagtga

SEQ ID NO: 41916 - DNA, 25 bp, Artificial Sequence
  Synthetic Construct
agaggaaaaatgaggactggttgaa

SEQ ID NO: 41917 - DNA, 24 bp, Artificial Sequence
  Synthetic Construct
ggcattgtgtgaagctggatattt

SEQ ID NO: 41918 - DNA, 27 bp, Artificial Sequence
  Synthetic Construct
ctataactgctctctcactgatccttt

SEQ ID NO: 41919 - DNA, 29 bp, Artificial Sequence
  Synthetic Construct
gagcctaatagtcacaagctatgaacaca

SEQ ID NO: 41920 - DNA, 23 bp, Artificial Sequence
  Synthetic Construct
ttggactttgtgtgcatcacttc

SEQ ID NO: 41921 - DNA, 22 bp, Artificial Sequence
  Synthetic Construct
cacccacagcctctttatgagt

SEQ ID NO: 41922 - DNA, 24 bp, Artificial Sequence
  Synthetic Construct
gttcagtcattggactgcttctgt

SEQ ID NO: 41923 - DNA, 25 bp, Artificial Sequence
  Synthetic Construct
cactagatagtggctgcttggagta

SEQ ID NO: 41924 - DNA, 20 bp, Artificial Sequence
  Synthetic Construct
ggtgagggcttgccttttca

SEQ ID NO: 41925 - DNA, 26 bp, Artificial Sequence
  Synthetic Construct
cttctatgttcgccaccactttaatc

SEQ ID NO: 41926 - DNA, 25 bp, Artificial Sequence
  Synthetic Construct
cctcctgtccaaaaggatgtcaaac

SEQ ID NO: 41927 - DNA, 20 bp, Artificial Sequence
  Synthetic Construct
tgtcagtggcctgtgcttga

SEQ ID NO: 41928 - DNA, 22 bp, Artificial Sequence
  Synthetic Construct
ggcttggccacatttgttgcat

SEQ ID NO: 41929 - DNA, 24 bp, Artificial Sequence
  Synthetic Construct
tcctctttcccagtttccttctct

SEQ ID NO: 41930 - DNA, 22 bp, Artificial Sequence
  Synthetic Construct
gctcagtgaattggcctcagaa

SEQ ID NO: 41931 - DNA, 23 bp, Artificial Sequence
  Synthetic Construct
ccttgatggaaagggtccggttt

SEQ ID NO: 41932 - DNA, 22 bp, Artificial Sequence
  Synthetic Construct
ggggaactccattaggggaaag

SEQ ID NO: 41933 - DNA, 22 bp, Artificial Sequence
  Synthetic Construct
gcaggaaggagctacccacttt

SEQ ID NO: 41934 - DNA, 23 bp, Artificial Sequence
  Synthetic Construct
cgttcaagcttgggaatggcata

SEQ ID NO: 41935 - DNA, 19 bp, Artificial Sequence
  Synthetic Construct
agggcgcctccggtttgta

SEQ ID NO: 41936 - DNA, 21 bp, Artificial Sequence
  Synthetic Construct
gtcactggacctcagcacttt

SEQ ID NO: 41937 - DNA, 24 bp, Artificial Sequence
  Synthetic Construct
agtctccttccttttctccgtgta

SEQ ID NO: 41938 - DNA, 22 bp, Artificial Sequence
  Synthetic Construct
tggctgaacaagagaaggcaaa

SEQ ID NO: 41939 - DNA, 23 bp, Artificial Sequence
  Synthetic Construct
ccgagagacacattcctttcagt

SEQ ID NO: 41940 - DNA, 22 bp, Artificial Sequence
  Synthetic Construct
gcaagcaaatggggagggacat

SEQ ID NO: 41941 - DNA, 24 bp, Artificial Sequence
  Synthetic Construct
tgtaaccaacttgaccacctctct

SEQ ID NO: 41942 - DNA, 23 bp, Artificial Sequence
  Synthetic Construct
gaggaagttgatgggaggtcatt

SEQ ID NO: 41943 - DNA, 24 bp, Artificial Sequence
  Synthetic Construct
gaggggtatgtgactttggtcttg

SEQ ID NO: 41944 - DNA, 22 bp, Artificial Sequence
  Synthetic Construct
tcaccatcatcctggcacattt

SEQ ID NO: 41945 - DNA, 20 bp, Artificial Sequence
  Synthetic Construct
gcaagaccctggctcaacaa

SEQ ID NO: 41946 - DNA, 26 bp, Artificial Sequence
  Synthetic Construct
ctcaaaacatctcaggtggcatgata

SEQ ID NO: 41947 - DNA, 20 bp, Artificial Sequence
  Synthetic Construct
aggctccccatgctgcttta

SEQ ID NO: 41948 - DNA, 21 bp, Artificial Sequence
  Synthetic Construct
gggaaaccaagggttgctgat

SEQ ID NO: 41949 - DNA, 19 bp, Artificial Sequence
  Synthetic Construct
aggtgggagggaggagtga

SEQ ID NO: 41950 - DNA, 21 bp, Artificial Sequence
  Synthetic Construct
tggctgacccctcctcaatca

SEQ ID NO: 41951 - DNA, 24 bp, Artificial Sequence
  Synthetic Construct
ttccaaaaggggatactgcatctt

SEQ ID NO: 41952 - DNA, 22 bp, Artificial Sequence
  Synthetic Construct
ggtggtggaaaaagcccaggtt

SEQ ID NO: 41953 - DNA, 21 bp, Artificial Sequence
  Synthetic Construct
tacgggcctttgacgcactac

SEQ ID NO: 41954 - DNA, 22 bp, Artificial Sequence
  Synthetic Construct
cctgggtatgtgtaggcagttt

SEQ ID NO: 41955 - DNA, 22 bp, Artificial Sequence
  Synthetic Construct
ggctggcggcataaagaggatt

SEQ ID NO: 41956 - DNA, 22 bp, Artificial Sequence
  Synthetic Construct
catggtatttcaaggcggcaat

SEQ ID NO: 41957 - DNA, 23 bp, Artificial Sequence
  Synthetic Construct
gctgcagtggcacaacaaccatt

SEQ ID NO: 41958 - DNA, 26 bp, Artificial Sequence
  Synthetic Construct
agctatctgggacattagaaccctat

SEQ ID NO: 41959 - DNA, 20 bp, Artificial Sequence
  Synthetic Construct
tcttgcaggtagcccagtca

SEQ ID NO: 41960 - DNA, 22 bp, Artificial Sequence
  Synthetic Construct
gctggggatagagctacaggat

SEQ ID NO: 41961 - DNA, 21 bp, Artificial Sequence
  Synthetic Construct
ttggcagagctttctgtgtga

SEQ ID NO: 41962 - DNA, 23 bp, Artificial Sequence
  Synthetic Construct
tgaagcaaggctcacattgaaac

SEQ ID NO: 41963 - DNA, 25 bp, Artificial Sequence
  Synthetic Construct
ggcagaggtagaggaaagttgttag

SEQ ID NO: 41964 - DNA, 27 bp, Artificial Sequence
  Synthetic Construct
gggaagaaactaccccagacttcattc

SEQ ID NO: 41965 - DNA, 19 bp, Artificial Sequence
  Synthetic Construct
ccagagcctgggtgacgat

SEQ ID NO: 41966 - DNA, 20 bp, Artificial Sequence
  Synthetic Construct
aggcccaagggctctttagt

SEQ ID NO: 41967 - DNA, 22 bp, Artificial Sequence
  Synthetic Construct
tccctagtggtggctccagtta

SEQ ID NO: 41968 - DNA, 24 bp, Artificial Sequence
  Synthetic Construct
gcataaaggtgctcagggaggaaa

SEQ ID NO: 41969 - DNA, 24 bp, Artificial Sequence
  Synthetic Construct
cactggacatctggcatcttggtt

SEQ ID NO: 41970 - DNA, 21 bp, Artificial Sequence
  Synthetic Construct
gccaacacaggacccttcctt

SEQ ID NO: 41971 - DNA, 24 bp, Artificial Sequence
  Synthetic Construct
ccacccttactcctgtctgtgaag

SEQ ID NO: 41972 - DNA, 20 bp, Artificial Sequence
  Synthetic Construct
ggcatggggtagcagcagat

SEQ ID NO: 41973 - DNA, 20 bp, Artificial Sequence
  Synthetic Construct
tgggtgctctcaccctgaca

SEQ ID NO: 41974 - DNA, 25 bp, Artificial Sequence
  Synthetic Construct
gggcactagcagtatgaagagactt

SEQ ID NO: 41975 - DNA, 23 bp, Artificial Sequence
  Synthetic Construct
cagtactccaggaaggagctgat

SEQ ID NO: 41976 - DNA, 22 bp, Artificial Sequence
  Synthetic Construct
ggctctgtgtcatcccttcctt

SEQ ID NO: 41977 - DNA, 22 bp, Artificial Sequence
  Synthetic Construct
gcatcagagcgtctctccaagt

SEQ ID NO: 41978 - DNA, 22 bp, Artificial Sequence
  Synthetic Construct
gtccaaggtaggtggggaaatg

SEQ ID NO: 41979 - DNA, 21 bp, Artificial Sequence
  Synthetic Construct
ccagtgtccgggctcaaacat

SEQ ID NO: 41980 - DNA, 20 bp, Artificial Sequence
  Synthetic Construct
tgggcaggactgaggctaca

SEQ ID NO: 41981 - DNA, 21 bp, Artificial Sequence
  Synthetic Construct
atgcagggagccagccatact

SEQ ID NO: 41982 - DNA, 21 bp, Artificial Sequence
  Synthetic Construct
tccccttcagcaactccaatg

SEQ ID NO: 41983 - DNA, 21 bp, Artificial Sequence
  Synthetic Construct
aacttgtggggaccggtggat

SEQ ID NO: 41984 - DNA, 24 bp, Artificial Sequence
  Synthetic Construct
ccggtaggtaacatccctgacatc

SEQ ID NO: 41985 - DNA, 28 bp, Artificial Sequence
  Synthetic Construct
caggatgcagtagctaaatctcactaag

SEQ ID NO: 41986 - DNA, 20 bp, Artificial Sequence
  Synthetic Construct
tggaccagggtgtggtcaag

SEQ ID NO: 41987 - DNA, 24 bp, Artificial Sequence
  Synthetic Construct
tgatctgtgggctatgcaatttct

SEQ ID NO: 41988 - DNA, 22 bp, Artificial Sequence
  Synthetic Construct
gggcctgcacctcagaaatgaa

SEQ ID NO: 41989 - DNA, 19 bp, Artificial Sequence
  Synthetic Construct
tgacccaagccccgagaag

SEQ ID NO: 41990 - DNA, 20 bp, Artificial Sequence
  Synthetic Construct
caagcccaagtccctgctta

SEQ ID NO: 41991 - DNA, 24 bp, Artificial Sequence
  Synthetic Construct
caggaagctctcaagcctaagttc

SEQ ID NO: 41992 - DNA, 22 bp, Artificial Sequence
  Synthetic Construct
gcagagctgggagcacattcat

SEQ ID NO: 41993 - DNA, 22 bp, Artificial Sequence
  Synthetic Construct
gccaacagtgcaggaaaactca

SEQ ID NO: 41994 - DNA, 18 bp, Artificial Sequence
  Synthetic Construct
gtgctgccctgtgagcat

SEQ ID NO: 41995 - DNA, 24 bp, Artificial Sequence
  Synthetic Construct
gtgtgtaacagccttcagctcagt

SEQ ID NO: 41996 - DNA, 24 bp, Artificial Sequence
  Synthetic Construct
tgggtaaatcaaggaaggaagcaa

SEQ ID NO: 41997 - DNA, 23 bp, Artificial Sequence
  Synthetic Construct
ccaggattccacctaggtttgtt

SEQ ID NO: 41998 - DNA, 22 bp, Artificial Sequence
  Synthetic Construct
gccagccaagtctaccatgttc

SEQ ID NO: 41999 - DNA, 22 bp, Artificial Sequence
  Synthetic Construct
gagcccctgggcattacatttg

SEQ ID NO: 42000 - DNA, 22 bp, Artificial Sequence
  Synthetic Construct
cctttcagtccagggtctgtgt

SEQ ID NO: 42001 - DNA, 24 bp, Artificial Sequence
  Synthetic Construct
ccttgcctcttcagctcattcctt

SEQ ID NO: 42002 - DNA, 25 bp, Artificial Sequence
  Synthetic Construct
tgatctattgcctttctgggcatac

SEQ ID NO: 42003 - DNA, 20 bp, Artificial Sequence
  Synthetic Construct
aaagcccctcgccccaactt

SEQ ID NO: 42004 - DNA, 23 bp, Artificial Sequence
  Synthetic Construct
gggcctggatgaacctagaaatg

SEQ ID NO: 42005 - DNA, 22 bp, Artificial Sequence
  Synthetic Construct
acaaactgggtggggtatgagt

SEQ ID NO: 42006 - DNA, 22 bp, Artificial Sequence
  Synthetic Construct
ctgttgccgggttgacttccta

SEQ ID NO: 42007 - DNA, 23 bp, Artificial Sequence
  Synthetic Construct
ctgagagactgtgatggccttgt

SEQ ID NO: 42008 - DNA, 22 bp, Artificial Sequence
  Synthetic Construct
ggcagtggcactagagatggaa

SEQ ID NO: 42009 - DNA, 20 bp, Artificial Sequence
  Synthetic Construct
gcccaacctgccatgtccta

SEQ ID NO: 42010 - DNA, 24 bp, Artificial Sequence
  Synthetic Construct
cccttcacatattcccacccttag

SEQ ID NO: 42011 - DNA, 25 bp, Artificial Sequence
  Synthetic Construct
tggtcaaggttagaatgttggatgt

SEQ ID NO: 42012 - DNA, 22 bp, Artificial Sequence
  Synthetic Construct
ctcctggctgaagggttaatgt

SEQ ID NO: 42013 - DNA, 21 bp, Artificial Sequence
  Synthetic Construct
tgccatcagctgtacctggaa

SEQ ID NO: 42014 - DNA, 20 bp, Artificial Sequence
  Synthetic Construct
cggggagtatgtggggatgt

SEQ ID NO: 42015 - DNA, 20 bp, Artificial Sequence
  Synthetic Construct
ccactgtgcccggacagaaa

SEQ ID NO: 42016 - DNA, 23 bp, Artificial Sequence
  Synthetic Construct
gaaggagaaagcatcagctctgt

SEQ ID NO: 42017 - DNA, 23 bp, Artificial Sequence
  Synthetic Construct
ttggagtgcatttgaggaacaac

SEQ ID NO: 42018 - DNA, 22 bp, Artificial Sequence
  Synthetic Construct
cggattcaccttgagcggcttt

SEQ ID NO: 42019 - DNA, 20 bp, Artificial Sequence
  Synthetic Construct
ttcagggatcccagctcctt

SEQ ID NO: 42020 - DNA, 20 bp, Artificial Sequence
  Synthetic Construct
gctccccttccagctcttgt

SEQ ID NO: 42021 - DNA, 20 bp, Artificial Sequence
  Synthetic Construct
ggagctggggtttggggaaa

SEQ ID NO: 42022 - DNA, 24 bp, Artificial Sequence
  Synthetic Construct
ggcaactcctgtactaccgtcctt

SEQ ID NO: 42023 - DNA, 21 bp, Artificial Sequence
  Synthetic Construct
tgcctcctgccgctatcagta

SEQ ID NO: 42024 - DNA, 25 bp, Artificial Sequence
  Synthetic Construct
gacttgcgatatccgggatcttaac

SEQ ID NO: 42025 - DNA, 23 bp, Artificial Sequence
  Synthetic Construct
atccagtagctgaaggtctctga

SEQ ID NO: 42026 - DNA, 20 bp, Artificial Sequence
  Synthetic Construct
gcaaactgcctgtcctgctt

SEQ ID NO: 42027 - DNA, 23 bp, Artificial Sequence
  Synthetic Construct
ggtaggagctggttccaacatga

SEQ ID NO: 42028 - DNA, 20 bp, Artificial Sequence
  Synthetic Construct
actctccgaggtgggcaaag

SEQ ID NO: 42029 - DNA, 22 bp, Artificial Sequence
  Synthetic Construct
acagcccttatggaggccttag

SEQ ID NO: 42030 - DNA, 22 bp, Artificial Sequence
  Synthetic Construct
agctggtctcagggaggaacaa

SEQ ID NO: 42031 - DNA, 21 bp, Artificial Sequence
  Synthetic Construct
aacccgacctgaggccctgaa

SEQ ID NO: 42032 - DNA, 25 bp, Artificial Sequence
  Synthetic Construct
tgagggtttaaggagataggggtta

SEQ ID NO: 42033 - DNA, 22 bp, Artificial Sequence
  Synthetic Construct
ggccaaaccctgtgactcttct

SEQ ID NO: 42034 - DNA, 23 bp, Artificial Sequence
  Synthetic Construct
ggctcaagtcagcagtgatggaa

SEQ ID NO: 42035 - DNA, 22 bp, Artificial Sequence
  Synthetic Construct
gggttcgtccaacttcctgtag

SEQ ID NO: 42036 - DNA, 23 bp, Artificial Sequence
  Synthetic Construct
tgcctttcctgaccagataccat

SEQ ID NO: 42037 - DNA, 23 bp, Artificial Sequence
  Synthetic Construct
ggtcccctcctaggtgtcgttta

SEQ ID NO: 42038 - DNA, 21 bp, Artificial Sequence
  Synthetic Construct
cccaactgcctgtggttggta

SEQ ID NO: 42039 - DNA, 20 bp, Artificial Sequence
  Synthetic Construct
gcgcttgctgctggttaaga

SEQ ID NO: 42040 - DNA, 25 bp, Artificial Sequence
  Synthetic Construct
caggttctagaaagtgtctgcttct

SEQ ID NO: 42041 - DNA, 22 bp, Artificial Sequence
  Synthetic Construct
gccatgccacaggcaagtaagt

SEQ ID NO: 42042 - DNA, 20 bp, Artificial Sequence
  Synthetic Construct
agaggctgcctgggctggaa

SEQ ID NO: 42043 - DNA, 20 bp, Artificial Sequence
  Synthetic Construct
tgggctgctttccccagttg

SEQ ID NO: 42044 - DNA, 26 bp, Artificial Sequence
  Synthetic Construct
tggagaagaatacaagtgaggctttg

SEQ ID NO: 42045 - DNA, 28 bp, Artificial Sequence
  Synthetic Construct
ctggggaattcaaaacaggagagaaaag

SEQ ID NO: 42046 - DNA, 22 bp, Artificial Sequence
  Synthetic Construct
gggctctatcgctctttggtaa

SEQ ID NO: 42047 - DNA, 24 bp, Artificial Sequence
  Synthetic Construct
gtgagctactaagagccaccaact

SEQ ID NO: 42048 - DNA, 20 bp, Artificial Sequence
  Synthetic Construct
agcagcagaaacccctcttg

SEQ ID NO: 42049 - DNA, 22 bp, Artificial Sequence
  Synthetic Construct
cccaatgtcttcccgtcacagt

SEQ ID NO: 42050 - DNA, 21 bp, Artificial Sequence
  Synthetic Construct
gttgcagcttggggagttaga

SEQ ID NO: 42051 - DNA, 23 bp, Artificial Sequence
  Synthetic Construct
atgtggtcatcgctaaacactct

SEQ ID NO: 42052 - DNA, 22 bp, Artificial Sequence
  Synthetic Construct
cgagcaaggggctactgatgaa

SEQ ID NO: 42053 - DNA, 22 bp, Artificial Sequence
  Synthetic Construct
gggagaatatttggccctgtga

SEQ ID NO: 42054 - DNA, 18 bp, Artificial Sequence
  Synthetic Construct
tggtgaccgtgcgaggaa

SEQ ID NO: 42055 - DNA, 20 bp, Artificial Sequence
  Synthetic Construct
ctggcagtctgggagagtca

SEQ ID NO: 42056 - DNA, 22 bp, Artificial Sequence
  Synthetic Construct
ccgagctacacgaggagatgaa

SEQ ID NO: 42057 - DNA, 25 bp, Artificial Sequence
  Synthetic Construct
cccactccaagaccttcaagaggaa

SEQ ID NO: 42058 - DNA, 22 bp, Artificial Sequence
  Synthetic Construct
gcaccttggcaggactcagaat

SEQ ID NO: 42059 - DNA, 26 bp, Artificial Sequence
  Synthetic Construct
ccccttagaaaaatgaggtggtgaga

SEQ ID NO: 42060 - DNA, 20 bp, Artificial Sequence
  Synthetic Construct
gcttcaacagcccagtgctt

SEQ ID NO: 42061 - DNA, 22 bp, Artificial Sequence
  Synthetic Construct
aacttggtcaggtggggttttt

SEQ ID NO: 42062 - DNA, 20 bp, Artificial Sequence
  Synthetic Construct
tcggggcttctgctgtcaaa

SEQ ID NO: 42063 - DNA, 23 bp, Artificial Sequence
  Synthetic Construct
cagtgttgccagatagagagctt

SEQ ID NO: 42064 - DNA, 22 bp, Artificial Sequence
  Synthetic Construct
ccagggttcacaagacaaggtt

SEQ ID NO: 42065 - DNA, 22 bp, Artificial Sequence
  Synthetic Construct
aacaagtgtggcagcataggta

SEQ ID NO: 42066 - DNA, 22 bp, Artificial Sequence
  Synthetic Construct
aggtgacccttccactcacatc

SEQ ID NO: 42067 - DNA, 19 bp, Artificial Sequence
  Synthetic Construct
ttgctagccacgggacaca

SEQ ID NO: 42068 - DNA, 20 bp, Artificial Sequence
  Synthetic Construct
ttgccccatcctgacacagt

SEQ ID NO: 42069 - DNA, 23 bp, Artificial Sequence
  Synthetic Construct
cagcaaacctacctgcgttgaag

SEQ ID NO: 42070 - DNA, 26 bp, Artificial Sequence
  Synthetic Construct
ggatgagctccttgtagttcttgttc

SEQ ID NO: 42071 - DNA, 24 bp, Artificial Sequence
  Synthetic Construct
gccatcaatcccatctgcttcaca

SEQ ID NO: 42072 - DNA, 22 bp, Artificial Sequence
  Synthetic Construct
aggaacccaccgatgcttcaac

SEQ ID NO: 42073 - DNA, 20 bp, Artificial Sequence
  Synthetic Construct
atgtctcgcaggctcctgta

SEQ ID NO: 42074 - DNA, 22 bp, Artificial Sequence
  Synthetic Construct
gcacccatctcattgccactgt

SEQ ID NO: 42075 - DNA, 25 bp, Artificial Sequence
  Synthetic Construct
attggggtgaatcagaactgtatgt

SEQ ID NO: 42076 - DNA, 20 bp, Artificial Sequence
  Synthetic Construct
gctacccagggagcccctta

SEQ ID NO: 42077 - DNA, 25 bp, Artificial Sequence
  Synthetic Construct
cctctattccaagcccaggcaaaag

SEQ ID NO: 42078 - DNA, 30 bp, Artificial Sequence
  Synthetic Construct
gggttttaacgaaagtaagggctaaagtct

SEQ ID NO: 42079 - DNA, 23 bp, Artificial Sequence
  Synthetic Construct
gagtaaggaggagtgcctcatgt

SEQ ID NO: 42080 - DNA, 23 bp, Artificial Sequence
  Synthetic Construct
gctcatggccatcctctctggta

SEQ ID NO: 42081 - DNA, 24 bp, Artificial Sequence
  Synthetic Construct
cacagaggtgggacctaccattac

SEQ ID NO: 42082 - DNA, 20 bp, Artificial Sequence
  Synthetic Construct
attcagtgcccagcatggtt

SEQ ID NO: 42083 - DNA, 21 bp, Artificial Sequence
  Synthetic Construct
gcaagttcaggccaacacgaa

SEQ ID NO: 42084 - DNA, 23 bp, Artificial Sequence
  Synthetic Construct
tgtgttccaatacctgcctgaat

SEQ ID NO: 42085 - DNA, 26 bp, Artificial Sequence
  Synthetic Construct
ggtgccagtggtgataaagtggtcta

SEQ ID NO: 42086 - DNA, 24 bp, Artificial Sequence
  Synthetic Construct
ggggtagtcaaggttgtctaggaa

SEQ ID NO: 42087 - DNA, 27 bp, Artificial Sequence
  Synthetic Construct
ggaagcttgaaacgaattgtgcagttt

SEQ ID NO: 42088 - DNA, 18 bp, Artificial Sequence
  Synthetic Construct
tgtgcacgcaagctcctt

SEQ ID NO: 42089 - DNA, 19 bp, Artificial Sequence
  Synthetic Construct
aggctggggctctgtcctt

SEQ ID NO: 42090 - DNA, 24 bp, Artificial Sequence
  Synthetic Construct
cctcaggattggcttctgggaaaa

SEQ ID NO: 42091 - DNA, 24 bp, Artificial Sequence
  Synthetic Construct
ggtccatacccaatggccaggatt

SEQ ID NO: 42092 - DNA, 22 bp, Artificial Sequence
  Synthetic Construct
aggggaaggagaatggccttag

SEQ ID NO: 42093 - DNA, 24 bp, Artificial Sequence
  Synthetic Construct
ccctaaatggttgctcctgaaact

SEQ ID NO: 42094 - DNA, 22 bp, Artificial Sequence
  Synthetic Construct
ccagcgtcatcttccagtgtca

SEQ ID NO: 42095 - DNA, 22 bp, Artificial Sequence
  Synthetic Construct
gtcactctccggctttaacact

SEQ ID NO: 42096 - DNA, 23 bp, Artificial Sequence
  Synthetic Construct
ggaagtgtctactgaccgcaaag

SEQ ID NO: 42097 - DNA, 20 bp, Artificial Sequence
  Synthetic Construct
cagtgtgcaactgggtgact

SEQ ID NO: 42098 - DNA, 21 bp, Artificial Sequence
  Synthetic Construct
ctgtgtgctgtctcagtgcaa

SEQ ID NO: 42099 - DNA, 18 bp, Artificial Sequence
  Synthetic Construct
acccactgccccacttca

SEQ ID NO: 42100 - DNA, 23 bp, Artificial Sequence
  Synthetic Construct
ctgactcttggcacagcctttag

SEQ ID NO: 42101 - DNA, 30 bp, Artificial Sequence
  Synthetic Construct
ctcaaactgtctaagtccgatgtaatggaa

SEQ ID NO: 42102 - DNA, 21 bp, Artificial Sequence
  Synthetic Construct
actcaccgatgtgcagagaga

SEQ ID NO: 42103 - DNA, 22 bp, Artificial Sequence
  Synthetic Construct
cactccaaaagcagtggcatgt

SEQ ID NO: 42104 - DNA, 20 bp, Artificial Sequence
  Synthetic Construct
acaggctttggcagcagact

SEQ ID NO: 42105 - DNA, 24 bp, Artificial Sequence
  Synthetic Construct
ccaaaagaggcacgctgagagaag

SEQ ID NO: 42106 - DNA, 22 bp, Artificial Sequence
  Synthetic Construct
atactggaccagaggctgatct

SEQ ID NO: 42107 - DNA, 25 bp, Artificial Sequence
  Synthetic Construct
gctgttggtattccttggggtgaag

SEQ ID NO: 42108 - DNA, 22 bp, Artificial Sequence
  Synthetic Construct
gcatagtccaccagaggcatgt

SEQ ID NO: 42109 - DNA, 20 bp, Artificial Sequence
  Synthetic Construct
ccgctttctgacaccaccaa

SEQ ID NO: 42110 - DNA, 20 bp, Artificial Sequence
  Synthetic Construct
ggcaggacacgtcgtaaaca

SEQ ID NO: 42111 - DNA, 22 bp, Artificial Sequence
  Synthetic Construct
ccctcctgccccatctctactt

SEQ ID NO: 42112 - DNA, 20 bp, Artificial Sequence
  Synthetic Construct
tctccgctcagcttctgtca

SEQ ID NO: 42113 - DNA, 22 bp, Artificial Sequence
  Synthetic Construct
gcacctgtgatgctgtgtggtt

SEQ ID NO: 42114 - DNA, 20 bp, Artificial Sequence
  Synthetic Construct
tgtggcatgaaggcaacaga

SEQ ID NO: 42115 - DNA, 22 bp, Artificial Sequence
  Synthetic Construct
ctgctacaacctccctcccaaa

SEQ ID NO: 42116 - DNA, 22 bp, Artificial Sequence
  Synthetic Construct
actaaagcctttggggcagaag

SEQ ID NO: 42117 - DNA, 24 bp, Artificial Sequence
  Synthetic Construct
gctcttggcacatgccatatgatt

SEQ ID NO: 42118 - DNA, 22 bp, Artificial Sequence
  Synthetic Construct
aacctgagacctgtccctgttg

SEQ ID NO: 42119 - DNA, 22 bp, Artificial Sequence
  Synthetic Construct
gcctagtgtctgtctcccaatg

SEQ ID NO: 42120 - DNA, 25 bp, Artificial Sequence
  Synthetic Construct
ggttggatagttggcaacccatgtt

SEQ ID NO: 42121 - DNA, 25 bp, Artificial Sequence
  Synthetic Construct
cctcagtcagttaagagctggcaaa

SEQ ID NO: 42122 - DNA, 19 bp, Artificial Sequence
  Synthetic Construct
atgttgggcctggctttgt

SEQ ID NO: 42123 - DNA, 21 bp, Artificial Sequence
  Synthetic Construct
ttccatcccagggcccctttt

SEQ ID NO: 42124 - DNA, 23 bp, Artificial Sequence
  Synthetic Construct
agaccttatattcgctgctgcat

SEQ ID NO: 42125 - DNA, 27 bp, Artificial Sequence
  Synthetic Construct
ggcaagttctaggaagacagttattct

SEQ ID NO: 42126 - DNA, 21 bp, Artificial Sequence
  Synthetic Construct
agcctcactggtgtgtgtttc

SEQ ID NO: 42127 - DNA, 21 bp, Artificial Sequence
  Synthetic Construct
gtgtctgcagcttgtgaccat

SEQ ID NO: 42128 - DNA, 20 bp, Artificial Sequence
  Synthetic Construct
actagaacacggggcagtga

SEQ ID NO: 42129 - DNA, 24 bp, Artificial Sequence
  Synthetic Construct
ctcaattcagctagaggcacacaa

SEQ ID NO: 42130 - DNA, 23 bp, Artificial Sequence
  Synthetic Construct
gccttacagggtagcccacctta

SEQ ID NO: 42131 - DNA, 20 bp, Artificial Sequence
  Synthetic Construct
gccgggccaatgttcaaatg

SEQ ID NO: 42132 - DNA, 22 bp, Artificial Sequence
  Synthetic Construct
gcttcttggaggaggttgcata

SEQ ID NO: 42133 - DNA, 23 bp, Artificial Sequence
  Synthetic Construct
gctgaggccccttttctccaaag

SEQ ID NO: 42134 - DNA, 25 bp, Artificial Sequence
  Synthetic Construct
ccactcctaggggtagatctagttg

SEQ ID NO: 42135 - DNA, 20 bp, Artificial Sequence
  Synthetic Construct
gcaatccaggctgggtcctt

SEQ ID NO: 42136 - DNA, 25 bp, Artificial Sequence
  Synthetic Construct
ctcccatcctctcatcttacctgtt

SEQ ID NO: 42137 - DNA, 24 bp, Artificial Sequence
  Synthetic Construct
ggtttatacctgcacatgccaatg

SEQ ID NO: 42138 - DNA, 27 bp, Artificial Sequence
  Synthetic Construct
ccctgaacaggcataccaacatataca

SEQ ID NO: 42139 - DNA, 29 bp, Artificial Sequence
  Synthetic Construct
ccccatagtttcctgcttccatctttgaa

SEQ ID NO: 42140 - DNA, 22 bp, Artificial Sequence
  Synthetic Construct
ccctgtggagcgactctactaa

SEQ ID NO: 42141 - DNA, 21 bp, Artificial Sequence
  Synthetic Construct
aggcaaggagctgggaaggtt

SEQ ID NO: 42142 - DNA, 23 bp, Artificial Sequence
  Synthetic Construct
gtggtcagttcttatggcagcta

SEQ ID NO: 42143 - DNA, 23 bp, Artificial Sequence
  Synthetic Construct
ggacggtccaggagatgtacctt

SEQ ID NO: 42144 - DNA, 24 bp, Artificial Sequence
  Synthetic Construct
gggacaatggggtaggatggagat

SEQ ID NO: 42145 - DNA, 20 bp, Artificial Sequence
  Synthetic Construct
tctgtgtgcccgtcctcaat

SEQ ID NO: 42146 - DNA, 22 bp, Artificial Sequence
  Synthetic Construct
gagtgccagatccaagccaatg

SEQ ID NO: 42147 - DNA, 25 bp, Artificial Sequence
  Synthetic Construct
cggtaagagctggagaagccatctt

SEQ ID NO: 42148 - DNA, 28 bp, Artificial Sequence
  Synthetic Construct
ccagccatagatcaccatatccccttag

SEQ ID NO: 42149 - DNA, 19 bp, Artificial Sequence
  Synthetic Construct
ggtgggagggacaggcaaa

SEQ ID NO: 42150 - DNA, 20 bp, Artificial Sequence
  Synthetic Construct
gctacaggctgactgtgcaa

SEQ ID NO: 42151 - DNA, 21 bp, Artificial Sequence
  Synthetic Construct
aggtggtgagtggtggggttt

SEQ ID NO: 42152 - DNA, 25 bp, Artificial Sequence
  Synthetic Construct
ggctttattcattcgcaaccctgtt

SEQ ID NO: 42153 - DNA, 23 bp, Artificial Sequence
  Synthetic Construct
ggcagtgggtagaggagacttca

SEQ ID NO: 42154 - DNA, 24 bp, Artificial Sequence
  Synthetic Construct
cctcggccagatttctactttttc

SEQ ID NO: 42155 - DNA, 23 bp, Artificial Sequence
  Synthetic Construct
ccatcacagcctaaccacggaat

SEQ ID NO: 42156 - DNA, 25 bp, Artificial Sequence
  Synthetic Construct
agttcaagttttctgacctggctat

SEQ ID NO: 42157 - DNA, 22 bp, Artificial Sequence
  Synthetic Construct
tggaagagggaggcaactctgt

SEQ ID NO: 42158 - DNA, 20 bp, Artificial Sequence
  Synthetic Construct
ggccactgcttgatgcaaag

SEQ ID NO: 42159 - DNA, 21 bp, Artificial Sequence
  Synthetic Construct
acaacaagcccaatgccgtta

SEQ ID NO: 42160 - DNA, 24 bp, Artificial Sequence
  Synthetic Construct
cacatgaggtgtttctctcccaat

SEQ ID NO: 42161 - DNA, 26 bp, Artificial Sequence
  Synthetic Construct
cctcatggcctgaaacaaaccctaac

SEQ ID NO: 42162 - DNA, 24 bp, Artificial Sequence
  Synthetic Construct
caaaggtttaggggcttcccatag

SEQ ID NO: 42163 - DNA, 26 bp, Artificial Sequence
  Synthetic Construct
tgctacattcaaaggggagtacaaag

SEQ ID NO: 42164 - DNA, 26 bp, Artificial Sequence
  Synthetic Construct
gtcattacatctgacccactctcagt

SEQ ID NO: 42165 - DNA, 25 bp, Artificial Sequence
  Synthetic Construct
caatgctcagtctctgtcttgaaac

SEQ ID NO: 42166 - DNA, 22 bp, Artificial Sequence
  Synthetic Construct
ggcacagagtgtgagacccaat

SEQ ID NO: 42167 - DNA, 25 bp, Artificial Sequence
  Synthetic Construct
gctctcccaagaattatctcaccaa

SEQ ID NO: 42168 - DNA, 22 bp, Artificial Sequence
  Synthetic Construct
gggcctaagctccatccaatct

SEQ ID NO: 42169 - DNA, 25 bp, Artificial Sequence
  Synthetic Construct
ccatcacattgctcaaactgctttc

SEQ ID NO: 42170 - DNA, 21 bp, Artificial Sequence
  Synthetic Construct
aggacgtgcattgggaacatc

SEQ ID NO: 42171 - DNA, 22 bp, Artificial Sequence
  Synthetic Construct
ccaagcaagggctccaggttta

SEQ ID NO: 42172 - DNA, 25 bp, Artificial Sequence
  Synthetic Construct
ctggatcataaaacgctacgtgact

SEQ ID NO: 42173 - DNA, 27 bp, Artificial Sequence
  Synthetic Construct
ggctttttccatctaatcaccaagatg

SEQ ID NO: 42174 - DNA, 23 bp, Artificial Sequence
  Synthetic Construct
agctacacaaaaagcctgggtaa

SEQ ID NO: 42175 - DNA, 22 bp, Artificial Sequence
  Synthetic Construct
cctgatccactggtggtcaact

SEQ ID NO: 42176 - DNA, 24 bp, Artificial Sequence
  Synthetic Construct
gattaaaatgcgctgactccaagt

SEQ ID NO: 42177 - DNA, 19 bp, Artificial Sequence
  Synthetic Construct
ccgtggtgggtgtgctgtt

SEQ ID NO: 42178 - DNA, 22 bp, Artificial Sequence
  Synthetic Construct
ggcttagagaggggaagcaact

SEQ ID NO: 42179 - DNA, 25 bp, Artificial Sequence
  Synthetic Construct
agaaggttctaggcagaaacagtag

SEQ ID NO: 42180 - DNA, 19 bp, Artificial Sequence
  Synthetic Construct
cctcctggcctgagccaaa

SEQ ID NO: 42181 - DNA, 26 bp, Artificial Sequence
  Synthetic Construct
acaattacagcagccatctaggttag

SEQ ID NO: 42182 - DNA, 20 bp, Artificial Sequence
  Synthetic Construct
cccaaaggcagggatccaaa

SEQ ID NO: 42183 - DNA, 20 bp, Artificial Sequence
  Synthetic Construct
ttaccctggcacacctgttg

SEQ ID NO: 42184 - DNA, 25 bp, Artificial Sequence
  Synthetic Construct
gggaaatccaggtaggcttcacaga

SEQ ID NO: 42185 - DNA, 20 bp, Artificial Sequence
  Synthetic Construct
acaggcacacaccactgcta

SEQ ID NO: 42186 - DNA, 23 bp, Artificial Sequence
  Synthetic Construct
gcttggtcctggatgtagcagat

SEQ ID NO: 42187 - DNA, 23 bp, Artificial Sequence
  Synthetic Construct
cctcaatctcccactggaaggaa

SEQ ID NO: 42188 - DNA, 22 bp, Artificial Sequence
  Synthetic Construct
tgatgtggctagctctctcgta

SEQ ID NO: 42189 - DNA, 23 bp, Artificial Sequence
  Synthetic Construct
gcctctcacgtaccattcacaca

SEQ ID NO: 42190 - DNA, 22 bp, Artificial Sequence
  Synthetic Construct
gtgggccaacttgaggtctgat

SEQ ID NO: 42191 - DNA, 23 bp, Artificial Sequence
  Synthetic Construct
cgcttgaaaacacgtccactaaa

SEQ ID NO: 42192 - DNA, 26 bp, Artificial Sequence
  Synthetic Construct
cttactactagtgtccagaggcaaag

SEQ ID NO: 42193 - DNA, 26 bp, Artificial Sequence
  Synthetic Construct
ggcctcttggccatagataacctgat

SEQ ID NO: 42194 - DNA, 25 bp, Artificial Sequence
  Synthetic Construct
ggacagcccaaagaatttgaacttg

SEQ ID NO: 42195 - DNA, 20 bp, Artificial Sequence
  Synthetic Construct
tcccaggattggctgctaca

SEQ ID NO: 42196 - DNA, 22 bp, Artificial Sequence
  Synthetic Construct
cccctgggaacagtgcaaagaa

SEQ ID NO: 42197 - DNA, 22 bp, Artificial Sequence
  Synthetic Construct
aacaggctttgtgactgctttg

SEQ ID NO: 42198 - DNA, 25 bp, Artificial Sequence
  Synthetic Construct
cactttatcttcaggtccgccaatc

SEQ ID NO: 42199 - DNA, 25 bp, Artificial Sequence
  Synthetic Construct
cctgaagtctggtctgttcctaaag

SEQ ID NO: 42200 - DNA, 20 bp, Artificial Sequence
  Synthetic Construct
tgctgctgagtggggattga

SEQ ID NO: 42201 - DNA, 22 bp, Artificial Sequence
  Synthetic Construct
gggcgacggagtaagtctttgt

SEQ ID NO: 42202 - DNA, 19 bp, Artificial Sequence
  Synthetic Construct
agctggccctgtggaggaa

SEQ ID NO: 42203 - DNA, 20 bp, Artificial Sequence
  Synthetic Construct
acctcctcaggggtgcagta

SEQ ID NO: 42204 - DNA, 22 bp, Artificial Sequence
  Synthetic Construct
gcagggaagatggcttcgtttc

SEQ ID NO: 42205 - DNA, 20 bp, Artificial Sequence
  Synthetic Construct
gccccaggtgcaacaacatt

SEQ ID NO: 42206 - DNA, 23 bp, Artificial Sequence
  Synthetic Construct
agaccacgagtgaggatgaaaag

SEQ ID NO: 42207 - DNA, 20 bp, Artificial Sequence
  Synthetic Construct
tgtcaccggcacccacttac

SEQ ID NO: 42208 - DNA, 21 bp, Artificial Sequence
  Synthetic Construct
cccatgtgagctgttgtgtca

SEQ ID NO: 42209 - DNA, 22 bp, Artificial Sequence
  Synthetic Construct
gcctggagaagcatgctagaga

SEQ ID NO: 42210 - DNA, 21 bp, Artificial Sequence
  Synthetic Construct
tcacggccacagtccatcaac

SEQ ID NO: 42211 - DNA, 22 bp, Artificial Sequence
  Synthetic Construct
tcctgacttaggagcggtgtga

SEQ ID NO: 42212 - DNA, 21 bp, Artificial Sequence
  Synthetic Construct
gccatcatgcagcctgacaac

SEQ ID NO: 42213 - DNA, 26 bp, Artificial Sequence
  Synthetic Construct
ggtagtcaagagatgatggtgtctct

SEQ ID NO: 42214 - DNA, 21 bp, Artificial Sequence
  Synthetic Construct
agtcgtggctcggatctgtga

SEQ ID NO: 42215 - DNA, 26 bp, Artificial Sequence
  Synthetic Construct
gacccattataaacagagctggacta

SEQ ID NO: 42216 - DNA, 25 bp, Artificial Sequence
  Synthetic Construct
ttttgcaatgagaatccacctcttc

SEQ ID NO: 42217 - DNA, 23 bp, Artificial Sequence
  Synthetic Construct
tttgacagaggacactcccaaag

SEQ ID NO: 42218 - DNA, 22 bp, Artificial Sequence
  Synthetic Construct
cctgtgctgtcgttgcctatac

SEQ ID NO: 42219 - DNA, 24 bp, Artificial Sequence
  Synthetic Construct
ctgtgataaaccatggagcctact

SEQ ID NO: 42220 - DNA, 20 bp, Artificial Sequence
  Synthetic Construct
gcttggaagagctgggcttt

SEQ ID NO: 42221 - DNA, 20 bp, Artificial Sequence
  Synthetic Construct
tggagagccagatgcaggaa

SEQ ID NO: 42222 - DNA, 22 bp, Artificial Sequence
  Synthetic Construct
ccaggacatcgatcaggacact

SEQ ID NO: 42223 - DNA, 23 bp, Artificial Sequence
  Synthetic Construct
gggaacctttggagaggtagatg

SEQ ID NO: 42224 - DNA, 19 bp, Artificial Sequence
  Synthetic Construct
atggacagccccagtgcaa

SEQ ID NO: 42225 - DNA, 19 bp, Artificial Sequence
  Synthetic Construct
acgctggctggaggagcaa

SEQ ID NO: 42226 - DNA, 22 bp, Artificial Sequence
  Synthetic Construct
ctgtcatacttcggccctcatc

SEQ ID NO: 42227 - DNA, 25 bp, Artificial Sequence
  Synthetic Construct
cacatgctgtatttactggctgctt

SEQ ID NO: 42228 - DNA, 27 bp, Artificial Sequence
  Synthetic Construct
ggcttaggcagggatctaggcatataa

SEQ ID NO: 42229 - DNA, 22 bp, Artificial Sequence
  Synthetic Construct
tccctacagctggagctcattg

SEQ ID NO: 42230 - DNA, 23 bp, Artificial Sequence
  Synthetic Construct
tctacctaccacgctggtattct

SEQ ID NO: 42231 - DNA, 26 bp, Artificial Sequence
  Synthetic Construct
ggagatgagaaacagaccccttaaac

SEQ ID NO: 42232 - DNA, 22 bp, Artificial Sequence
  Synthetic Construct
aggcaggttgaatcccctctca

SEQ ID NO: 42233 - DNA, 23 bp, Artificial Sequence
  Synthetic Construct
tgcttgttagctaaggacaccat

SEQ ID NO: 42234 - DNA, 20 bp, Artificial Sequence
  Synthetic Construct
ggtgtcgtctgcagcaaagt

SEQ ID NO: 42235 - DNA, 20 bp, Artificial Sequence
  Synthetic Construct
agatgctgctctggcagtga

SEQ ID NO: 42236 - DNA, 20 bp, Artificial Sequence
  Synthetic Construct
gctgcctgcacacggataaa

SEQ ID NO: 42237 - DNA, 26 bp, Artificial Sequence
  Synthetic Construct
gcaagtctctaagatcagcccagatt

SEQ ID NO: 42238 - DNA, 27 bp, Artificial Sequence
  Synthetic Construct
gcatctgcaaacaaatctgtcctccaa

SEQ ID NO: 42239 - DNA, 23 bp, Artificial Sequence
  Synthetic Construct
tcctccatccacccctctacctt

SEQ ID NO: 42240 - DNA, 26 bp, Artificial Sequence
  Synthetic Construct
ggtgtttccagattgccagtttcttc

SEQ ID NO: 42241 - DNA, 19 bp, Artificial Sequence
  Synthetic Construct
gccatctgcctgccctgaa

SEQ ID NO: 42242 - DNA, 21 bp, Artificial Sequence
  Synthetic Construct
aggagacagagctcgcaggat

SEQ ID NO: 42243 - DNA, 27 bp, Artificial Sequence
  Synthetic Construct
ctcatgaattaagacaaggcctcttga

SEQ ID NO: 42244 - DNA, 22 bp, Artificial Sequence
  Synthetic Construct
ggagaaaggctgtagggacttc

SEQ ID NO: 42245 - DNA, 19 bp, Artificial Sequence
  Synthetic Construct
tttgtgggccacgccaatg

SEQ ID NO: 42246 - DNA, 20 bp, Artificial Sequence
  Synthetic Construct
tcagcagctcttcccagcat

SEQ ID NO: 42247 - DNA, 23 bp, Artificial Sequence
  Synthetic Construct
gtctgttccccttgaacctgtgt

SEQ ID NO: 42248 - DNA, 22 bp, Artificial Sequence
  Synthetic Construct
gtcttaaggcagctgtggtttg

SEQ ID NO: 42249 - DNA, 22 bp, Artificial Sequence
  Synthetic Construct
gaaaatctggggctctgctcaa

SEQ ID NO: 42250 - DNA, 20 bp, Artificial Sequence
  Synthetic Construct
ggcaaggtgaatggggatgt

SEQ ID NO: 42251 - DNA, 23 bp, Artificial Sequence
  Synthetic Construct
ccgccctttccgtatcagaaact

SEQ ID NO: 42252 - DNA, 20 bp, Artificial Sequence
  Synthetic Construct
aagtggcaggcctcatcttc

SEQ ID NO: 42253 - DNA, 22 bp, Artificial Sequence
  Synthetic Construct
gggacaagtcaggggcatctta

SEQ ID NO: 42254 - DNA, 30 bp, Artificial Sequence
  Synthetic Construct
gagacagaaaaactaagactcactctcctt

SEQ ID NO: 42255 - DNA, 23 bp, Artificial Sequence
  Synthetic Construct
gcccaaaacataccttggagtca

SEQ ID NO: 42256 - DNA, 21 bp, Artificial Sequence
  Synthetic Construct
agagtgccagcccctgatgta

SEQ ID NO: 42257 - DNA, 24 bp, Artificial Sequence
  Synthetic Construct
gcccaaggagggtaactagtccat

SEQ ID NO: 42258 - DNA, 20 bp, Artificial Sequence
  Synthetic Construct
gaagaccaaggtgccagcat

SEQ ID NO: 42259 - DNA, 22 bp, Artificial Sequence
  Synthetic Construct
ctggtcctatggccaccttaga

SEQ ID NO: 42260 - DNA, 22 bp, Artificial Sequence
  Synthetic Construct
agtctctatggggagggtcaac

SEQ ID NO: 42261 - DNA, 20 bp, Artificial Sequence
  Synthetic Construct
acagcagctccaacccattc

SEQ ID NO: 42262 - DNA, 20 bp, Artificial Sequence
  Synthetic Construct
ccgcggtgtaaggactgaat

SEQ ID NO: 42263 - DNA, 25 bp, Artificial Sequence
  Synthetic Construct
ccagtcacttctgtgttacctgtca

SEQ ID NO: 42264 - DNA, 23 bp, Artificial Sequence
  Synthetic Construct
gggcctgatgtccatgatgattc

SEQ ID NO: 42265 - DNA, 25 bp, Artificial Sequence
  Synthetic Construct
gtgttttagatgggctacagcaatg

SEQ ID NO: 42266 - DNA, 21 bp, Artificial Sequence
  Synthetic Construct
gtggaatgccatgtgcctttg

SEQ ID NO: 42267 - DNA, 22 bp, Artificial Sequence
  Synthetic Construct
gctggacgaagacaagcctctt

SEQ ID NO: 42268 - DNA, 25 bp, Artificial Sequence
  Synthetic Construct
tgtccgactacacttggatatttgt

SEQ ID NO: 42269 - DNA, 24 bp, Artificial Sequence
  Synthetic Construct
ggtcgggctagtggatagtctttg

SEQ ID NO: 42270 - DNA, 20 bp, Artificial Sequence
  Synthetic Construct
tgacgtgggatgagggatgt

SEQ ID NO: 42271 - DNA, 23 bp, Artificial Sequence
  Synthetic Construct
tcttgaacagctccttcccctta

SEQ ID NO: 42272 - DNA, 24 bp, Artificial Sequence
  Synthetic Construct
ggttccaagtttgaaagcccttag

SEQ ID NO: 42273 - DNA, 21 bp, Artificial Sequence
  Synthetic Construct
tctccaagtctgtcgtgcaaa

SEQ ID NO: 42274 - DNA, 27 bp, Artificial Sequence
  Synthetic Construct
ggtgcttgactaggaagctaaagaatc

SEQ ID NO: 42275 - DNA, 21 bp, Artificial Sequence
  Synthetic Construct
gggctgaagacgggtgactaa

SEQ ID NO: 42276 - DNA, 23 bp, Artificial Sequence
  Synthetic Construct
ggatgtggaactcaaccctggaa

SEQ ID NO: 42277 - DNA, 21 bp, Artificial Sequence
  Synthetic Construct
cacacttcgcttccggattca

SEQ ID NO: 42278 - DNA, 26 bp, Artificial Sequence
  Synthetic Construct
ccagaaagcagaagggaattggcatt

SEQ ID NO: 42279 - DNA, 25 bp, Artificial Sequence
  Synthetic Construct
ctccaaatatgacttccccttccat

SEQ ID NO: 42280 - DNA, 21 bp, Artificial Sequence
  Synthetic Construct
cctctggcagttcgccatcta

SEQ ID NO: 42281 - DNA, 20 bp, Artificial Sequence
  Synthetic Construct
ggttagcaagcctgcgacaa

SEQ ID NO: 42282 - DNA, 20 bp, Artificial Sequence
  Synthetic Construct
gctgctgggcgaccataaat

SEQ ID NO: 42283 - DNA, 24 bp, Artificial Sequence
  Synthetic Construct
gagtatgatgctcccaagcctaga

SEQ ID NO: 42284 - DNA, 21 bp, Artificial Sequence
  Synthetic Construct
ggagccagtgaaggtttctga

SEQ ID NO: 42285 - DNA, 21 bp, Artificial Sequence
  Synthetic Construct
cccctaccaagccaggatgta

SEQ ID NO: 42286 - DNA, 24 bp, Artificial Sequence
  Synthetic Construct
acaagggagtgaaatgttctgtct

SEQ ID NO: 42287 - DNA, 20 bp, Artificial Sequence
  Synthetic Construct
aaccacaggcctggctgata

SEQ ID NO: 42288 - DNA, 20 bp, Artificial Sequence
  Synthetic Construct
actgcaaccccaaccagtct

SEQ ID NO: 42289 - DNA, 28 bp, Artificial Sequence
  Synthetic Construct
gcatagaggaccgaagaatgttttgaac

SEQ ID NO: 42290 - DNA, 24 bp, Artificial Sequence
  Synthetic Construct
caggtgagaggagggttcagttag

SEQ ID NO: 42291 - DNA, 23 bp, Artificial Sequence
  Synthetic Construct
acaggtcctgacagcattagtga

SEQ ID NO: 42292 - DNA, 24 bp, Artificial Sequence
  Synthetic Construct
gtgagaaaagcagggaccctattg

SEQ ID NO: 42293 - DNA, 20 bp, Artificial Sequence
  Synthetic Construct
tggctccacagggactgatt

SEQ ID NO: 42294 - DNA, 22 bp, Artificial Sequence
  Synthetic Construct
atggaatggggagagacaggat

SEQ ID NO: 42295 - DNA, 24 bp, Artificial Sequence
  Synthetic Construct
gagtccttaccccaggtattctca

SEQ ID NO: 42296 - DNA, 20 bp, Artificial Sequence
  Synthetic Construct
gcaccaggcttctcagcatt

SEQ ID NO: 42297 - DNA, 23 bp, Artificial Sequence
  Synthetic Construct
ctaacctctctttgctgggaaca

SEQ ID NO: 42298 - DNA, 20 bp, Artificial Sequence
  Synthetic Construct
tggaggtgcactgctcagat

SEQ ID NO: 42299 - DNA, 25 bp, Artificial Sequence
  Synthetic Construct
gtccattgagtcaaaattcccagtt

SEQ ID NO: 42300 - DNA, 22 bp, Artificial Sequence
  Synthetic Construct
gactgaccttgccaccctgtaa

SEQ ID NO: 42301 - DNA, 22 bp, Artificial Sequence
  Synthetic Construct
cattgcacccgtaagtcctttg

SEQ ID NO: 42302 - DNA, 23 bp, Artificial Sequence
  Synthetic Construct
ggttccagtatggtggaggaatg

SEQ ID NO: 42303 - DNA, 23 bp, Artificial Sequence
  Synthetic Construct
gtgcgaggaaataggggtgattg

SEQ ID NO: 42304 - DNA, 23 bp, Artificial Sequence
  Synthetic Construct
tgaccagaaagattggcagcatt

SEQ ID NO: 42305 - DNA, 25 bp, Artificial Sequence
  Synthetic Construct
ctttgagcaacactgatggagaaga

SEQ ID NO: 42306 - DNA, 20 bp, Artificial Sequence
  Synthetic Construct
aggtgactggctgtgctaga

SEQ ID NO: 42307 - DNA, 20 bp, Artificial Sequence
  Synthetic Construct
cagccaacagccacatgagt

SEQ ID NO: 42308 - DNA, 21 bp, Artificial Sequence
  Synthetic Construct
ttcagggctggtgctctccat

SEQ ID NO: 42309 - DNA, 27 bp, Artificial Sequence
  Synthetic Construct
cagttgctataccaagagggtttattc

SEQ ID NO: 42310 - DNA, 22 bp, Artificial Sequence
  Synthetic Construct
gccagtgtaagtcctggagtct

SEQ ID NO: 42311 - DNA, 21 bp, Artificial Sequence
  Synthetic Construct
tctttttgggcgctgtgttct

SEQ ID NO: 42312 - DNA, 21 bp, Artificial Sequence
  Synthetic Construct
tgagtgaccgagagcctggaa

SEQ ID NO: 42313 - DNA, 23 bp, Artificial Sequence
  Synthetic Construct
cctcacactggtagccatgcttt

SEQ ID NO: 42314 - DNA, 25 bp, Artificial Sequence
  Synthetic Construct
gacagagcatccccttatctgaatc

SEQ ID NO: 42315 - DNA, 25 bp, Artificial Sequence
  Synthetic Construct
gggaacagataggtagcatggagta

SEQ ID NO: 42316 - DNA, 25 bp, Artificial Sequence
  Synthetic Construct
gcacagcacttaggtcagagagaga

SEQ ID NO: 42317 - DNA, 24 bp, Artificial Sequence
  Synthetic Construct
gcttccaaactgaactgcttccaa

SEQ ID NO: 42318 - DNA, 22 bp, Artificial Sequence
  Synthetic Construct
gcaaatgaggtcgtgtttggaa

SEQ ID NO: 42319 - DNA, 22 bp, Artificial Sequence
  Synthetic Construct
gccaggcacagatagctccata

SEQ ID NO: 42320 - DNA, 24 bp, Artificial Sequence
  Synthetic Construct
ttcccaaatcaagaacccttcctt

SEQ ID NO: 42321 - DNA, 24 bp, Artificial Sequence
  Synthetic Construct
agcatgaatgggagaatagcaagt

SEQ ID NO: 42322 - DNA, 23 bp, Artificial Sequence
  Synthetic Construct
gcaaagctggatctgtggctgtt

SEQ ID NO: 42323 - DNA, 24 bp, Artificial Sequence
  Synthetic Construct
cagaaaggtctgcttaagggctat

SEQ ID NO: 42324 - DNA, 27 bp, Artificial Sequence
  Synthetic Construct
ggaggtattcaatgagacagcaggtat

SEQ ID NO: 42325 - DNA, 19 bp, Artificial Sequence
  Synthetic Construct
ccagttcccctggctctga

SEQ ID NO: 42326 - DNA, 25 bp, Artificial Sequence
  Synthetic Construct
ttctctagcacaaagctctccatag

SEQ ID NO: 42327 - DNA, 25 bp, Artificial Sequence
  Synthetic Construct
gtaactctgcaacaaccttgtgtaa

SEQ ID NO: 42328 - DNA, 20 bp, Artificial Sequence
  Synthetic Construct
cctccaactcctgggctcaa

SEQ ID NO: 42329 - DNA, 26 bp, Artificial Sequence
  Synthetic Construct
gcatctgccctacattctatggtttg

SEQ ID NO: 42330 - DNA, 21 bp, Artificial Sequence
  Synthetic Construct
tgcttgttgcttttgcaccat

SEQ ID NO: 42331 - DNA, 24 bp, Artificial Sequence
  Synthetic Construct
aaggtaaaactctgaaccgtctgt

SEQ ID NO: 42332 - DNA, 25 bp, Artificial Sequence
  Synthetic Construct
cctgctattcctcccataggcacat

SEQ ID NO: 42333 - DNA, 22 bp, Artificial Sequence
  Synthetic Construct
tccacagtggctgttcagaatc

SEQ ID NO: 42334 - DNA, 28 bp, Artificial Sequence
  Synthetic Construct
gtcctcttgttttcccttagttgtgaag

SEQ ID NO: 42335 - DNA, 25 bp, Artificial Sequence
  Synthetic Construct
tgttactacttcagctggcatctac

SEQ ID NO: 42336 - DNA, 23 bp, Artificial Sequence
  Synthetic Construct
ggaaagagtgggaaggactgtgt

SEQ ID NO: 42337 - DNA, 23 bp, Artificial Sequence
  Synthetic Construct
ggcagtaatgggcagtaagttct

SEQ ID NO: 42338 - DNA, 25 bp, Artificial Sequence
  Synthetic Construct
cgactaccaagtttctggaggaaag

SEQ ID NO: 42339 - DNA, 20 bp, Artificial Sequence
  Synthetic Construct
agggctgctgcacaggattt

SEQ ID NO: 42340 - DNA, 20 bp, Artificial Sequence
  Synthetic Construct
gcttttgttgcctgggcttt

SEQ ID NO: 42341 - DNA, 20 bp, Artificial Sequence
  Synthetic Construct
tcccctgtcctcctgctctt

SEQ ID NO: 42342 - DNA, 20 bp, Artificial Sequence
  Synthetic Construct
acaggccaagcctgctcaga

SEQ ID NO: 42343 - DNA, 24 bp, Artificial Sequence
  Synthetic Construct
cacatttggaaaggaccccagtca

SEQ ID NO: 42344 - DNA, 22 bp, Artificial Sequence
  Synthetic Construct
cctccgcagatcttggagatga

SEQ ID NO: 42345 - DNA, 26 bp, Artificial Sequence
  Synthetic Construct
ggcaaaccaatagcaaagagccaact

SEQ ID NO: 42346 - DNA, 23 bp, Artificial Sequence
  Synthetic Construct
tgcaaacaacccaggaaggtaag

SEQ ID NO: 42347 - DNA, 19 bp, Artificial Sequence
  Synthetic Construct
ttgtggcggcgacgtggta

SEQ ID NO: 42348 - DNA, 22 bp, Artificial Sequence
  Synthetic Construct
tgacctgagagagggtccaaag

SEQ ID NO: 42349 - DNA, 24 bp, Artificial Sequence
  Synthetic Construct
gatggcattatatcagggctgtgt

SEQ ID NO: 42350 - DNA, 20 bp, Artificial Sequence
  Synthetic Construct
tgcccctagccttgaagttg

SEQ ID NO: 42351 - DNA, 21 bp, Artificial Sequence
  Synthetic Construct
ccaccgtgcctgaccaattct

SEQ ID NO: 42352 - DNA, 25 bp, Artificial Sequence
  Synthetic Construct
cgctttcccaatgtaccaggtctca

SEQ ID NO: 42353 - DNA, 25 bp, Artificial Sequence
  Synthetic Construct
gctctaatagctacgggcaatggat

SEQ ID NO: 42354 - DNA, 24 bp, Artificial Sequence
  Synthetic Construct
ggtttgaccctcaacatgtgtcat

SEQ ID NO: 42355 - DNA, 23 bp, Artificial Sequence
  Synthetic Construct
gtcgaatctaccctcgtcagctt

SEQ ID NO: 42356 - DNA, 20 bp, Artificial Sequence
  Synthetic Construct
tctctccaggcttggtcctt

SEQ ID NO: 42357 - DNA, 25 bp, Artificial Sequence
  Synthetic Construct
tgtgtagaattttacgtgggcctaa

SEQ ID NO: 42358 - DNA, 22 bp, Artificial Sequence
  Synthetic Construct
gtgtctggggtagtcacagatg

SEQ ID NO: 42359 - DNA, 22 bp, Artificial Sequence
  Synthetic Construct
cataccaaccaaggaggctgaa

SEQ ID NO: 42360 - DNA, 26 bp, Artificial Sequence
  Synthetic Construct
gcaactatcagggtgaagaaccattg

SEQ ID NO: 42361 - DNA, 22 bp, Artificial Sequence
  Synthetic Construct
ctcctggactcaagcaatccat

SEQ ID NO: 42362 - DNA, 23 bp, Artificial Sequence
  Synthetic Construct
ttccttcaaagcagagggtcatt

SEQ ID NO: 42363 - DNA, 20 bp, Artificial Sequence
  Synthetic Construct
tgccccaaggctagtgttct

SEQ ID NO: 42364 - DNA, 29 bp, Artificial Sequence
  Synthetic Construct
ggcattttgactgtggatctttgctcttg

SEQ ID NO: 42365 - DNA, 20 bp, Artificial Sequence
  Synthetic Construct
cttggctgcttttggcaagt

SEQ ID NO: 42366 - DNA, 23 bp, Artificial Sequence
  Synthetic Construct
atctacctggcctgaaagacaag

SEQ ID NO: 42367 - DNA, 22 bp, Artificial Sequence
  Synthetic Construct
gcacggctgggtggaaataagt

SEQ ID NO: 42368 - DNA, 22 bp, Artificial Sequence
  Synthetic Construct
gcatgaaggtggcagtggactt

SEQ ID NO: 42369 - DNA, 25 bp, Artificial Sequence
  Synthetic Construct
ggaaagatttgccaaaggttgtcta

SEQ ID NO: 42370 - DNA, 20 bp, Artificial Sequence
  Synthetic Construct
ggcttctgtgcaccctggaa

SEQ ID NO: 42371 - DNA, 22 bp, Artificial Sequence
  Synthetic Construct
gtgttgggaggctctggaatca

SEQ ID NO: 42372 - DNA, 20 bp, Artificial Sequence
  Synthetic Construct
gccagcaagcagctacacat

SEQ ID NO: 42373 - DNA, 23 bp, Artificial Sequence
  Synthetic Construct
caccgctatgtcctctccatttc

SEQ ID NO: 42374 - DNA, 22 bp, Artificial Sequence
  Synthetic Construct
ccagaggaatgcaggagtcaga

SEQ ID NO: 42375 - DNA, 20 bp, Artificial Sequence
  Synthetic Construct
actctgtgaaggggctgagt

SEQ ID NO: 42376 - DNA, 29 bp, Artificial Sequence
  Synthetic Construct
gggtgagataaactgtttcagtggttttc

SEQ ID NO: 42377 - DNA, 21 bp, Artificial Sequence
  Synthetic Construct
aaaagctcctggctgtgtcat

SEQ ID NO: 42378 - DNA, 20 bp, Artificial Sequence
  Synthetic Construct
ggaggtaggtggggcacaaa

SEQ ID NO: 42379 - DNA, 24 bp, Artificial Sequence
  Synthetic Construct
ggatcccaaagcactttacacatc

SEQ ID NO: 42380 - DNA, 23 bp, Artificial Sequence
  Synthetic Construct
gctaaacaggattccaggctttg

SEQ ID NO: 42381 - DNA, 22 bp, Artificial Sequence
  Synthetic Construct
ctgaacacaaacctgcctgaca

SEQ ID NO: 42382 - DNA, 25 bp, Artificial Sequence
  Synthetic Construct
ccaatgtcagaactagaagggaact

SEQ ID NO: 42383 - DNA, 22 bp, Artificial Sequence
  Synthetic Construct
tgtagagtccctctgggcttca

SEQ ID NO: 42384 - DNA, 23 bp, Artificial Sequence
  Synthetic Construct
ccttctcctaccctcccactaca

SEQ ID NO: 42385 - DNA, 22 bp, Artificial Sequence
  Synthetic Construct
gtgactctgctttccaccatgt

SEQ ID NO: 42386 - DNA, 20 bp, Artificial Sequence
  Synthetic Construct
ttggcagctcaggggtttag

SEQ ID NO: 42387 - DNA, 21 bp, Artificial Sequence
  Synthetic Construct
ttgagggcctttgctcaagaa

SEQ ID NO: 42388 - DNA, 21 bp, Artificial Sequence
  Synthetic Construct
ggcgtcacagtcctgatggtt

SEQ ID NO: 42389 - DNA, 20 bp, Artificial Sequence
  Synthetic Construct
ctgcttggccacagaagaca

SEQ ID NO: 42390 - DNA, 19 bp, Artificial Sequence
  Synthetic Construct
gcccagggctgtctccttt

SEQ ID NO: 42391 - DNA, 30 bp, Artificial Sequence
  Synthetic Construct
cctcttggaagatacctaaatcaacacaca

SEQ ID NO: 42392 - DNA, 25 bp, Artificial Sequence
  Synthetic Construct
gacttcctaagagcaaggacctagt

SEQ ID NO: 42393 - DNA, 20 bp, Artificial Sequence
  Synthetic Construct
cgcgcccggccttatatagt

SEQ ID NO: 42394 - DNA, 24 bp, Artificial Sequence
  Synthetic Construct
aagaccctctggcctttttagttt

SEQ ID NO: 42395 - DNA, 22 bp, Artificial Sequence
  Synthetic Construct
gtgggttttcccatgctcattc

SEQ ID NO: 42396 - DNA, 22 bp, Artificial Sequence
  Synthetic Construct
cggtcttcccatcacctgcaat

SEQ ID NO: 42397 - DNA, 22 bp, Artificial Sequence
  Synthetic Construct
ggaacagtaggcactggggatt

SEQ ID NO: 42398 - DNA, 23 bp, Artificial Sequence
  Synthetic Construct
acctcaccgtacttgttctctct

SEQ ID NO: 42399 - DNA, 22 bp, Artificial Sequence
  Synthetic Construct
gtcatgtccctcaggtgtgttg

SEQ ID NO: 42400 - DNA, 21 bp, Artificial Sequence
  Synthetic Construct
acagaggactggccccacaaa

SEQ ID NO: 42401 - DNA, 24 bp, Artificial Sequence
  Synthetic Construct
gttccatcagattggcttgtgtca

SEQ ID NO: 42402 - DNA, 21 bp, Artificial Sequence
  Synthetic Construct
ggcagcacattgcacaagact

SEQ ID NO: 42403 - DNA, 22 bp, Artificial Sequence
  Synthetic Construct
gtcctccagggcctcagatatt

SEQ ID NO: 42404 - DNA, 23 bp, Artificial Sequence
  Synthetic Construct
ctggcttgactttctgccctcta

SEQ ID NO: 42405 - DNA, 24 bp, Artificial Sequence
  Synthetic Construct
cctcttaaggccttgtcccagaag

SEQ ID NO: 42406 - DNA, 20 bp, Artificial Sequence
  Synthetic Construct
aggccccgagatgggaacta

SEQ ID NO: 42407 - DNA, 20 bp, Artificial Sequence
  Synthetic Construct
tcctcttgccgtgggatctt

SEQ ID NO: 42408 - DNA, 23 bp, Artificial Sequence
  Synthetic Construct
gatggagtttgtcccttcgtttg

SEQ ID NO: 42409 - DNA, 23 bp, Artificial Sequence
  Synthetic Construct
ccatcagtgggagctgaaaaaca

SEQ ID NO: 42410 - DNA, 21 bp, Artificial Sequence
  Synthetic Construct
acctgcatctgtgcctgatct

SEQ ID NO: 42411 - DNA, 21 bp, Artificial Sequence
  Synthetic Construct
cctgctgccatctggggaaaa

SEQ ID NO: 42412 - DNA, 20 bp, Artificial Sequence
  Synthetic Construct
tgcctcctgcaaaggtcaga

SEQ ID NO: 42413 - DNA, 24 bp, Artificial Sequence
  Synthetic Construct
ccctccaaatctgagctggccttt

SEQ ID NO: 42414 - DNA, 19 bp, Artificial Sequence
  Synthetic Construct
tgggctgcgagtgctgaaa

SEQ ID NO: 42415 - DNA, 22 bp, Artificial Sequence
  Synthetic Construct
caggacccaagctgtctggaaa

SEQ ID NO: 42416 - DNA, 20 bp, Artificial Sequence
  Synthetic Construct
ttctgccctacccagagcat

SEQ ID NO: 42417 - DNA, 26 bp, Artificial Sequence
  Synthetic Construct
tcatacacccagatataccgatcact

SEQ ID NO: 42418 - DNA, 18 bp, Artificial Sequence
  Synthetic Construct
actcagcaggcccacctt

SEQ ID NO: 42419 - DNA, 26 bp, Artificial Sequence
  Synthetic Construct
ggggaaggtttatttcctctccaact

SEQ ID NO: 42420 - DNA, 20 bp, Artificial Sequence
  Synthetic Construct
attccctgtccccagactgt

SEQ ID NO: 42421 - DNA, 22 bp, Artificial Sequence
  Synthetic Construct
ggcgaggtgttgtgatcctttg

SEQ ID NO: 42422 - DNA, 21 bp, Artificial Sequence
  Synthetic Construct
tgaacgaggactctgggacat

SEQ ID NO: 42423 - DNA, 23 bp, Artificial Sequence
  Synthetic Construct
tttggaggcaaccagatgttttg

SEQ ID NO: 42424 - DNA, 21 bp, Artificial Sequence
  Synthetic Construct
gatggttgagatggcgagagt

SEQ ID NO: 42425 - DNA, 24 bp, Artificial Sequence
  Synthetic Construct
gccaacccttccctttatccacta

SEQ ID NO: 42426 - DNA, 24 bp, Artificial Sequence
  Synthetic Construct
tgaaagccttgccatattcccatt

SEQ ID NO: 42427 - DNA, 21 bp, Artificial Sequence
  Synthetic Construct
ggggttgaacacttccagtga

SEQ ID NO: 42428 - DNA, 24 bp, Artificial Sequence
  Synthetic Construct
ctggctgatgaaaagtccctgatg

SEQ ID NO: 42429 - DNA, 24 bp, Artificial Sequence
  Synthetic Construct
ggctcctcaagattgactccaaca

SEQ ID NO: 42430 - DNA, 27 bp, Artificial Sequence
  Synthetic Construct
cacctgcttttctatagttgccctgaa

SEQ ID NO: 42431 - DNA, 26 bp, Artificial Sequence
  Synthetic Construct
caaaactgaggccaaagctatcaaag

SEQ ID NO: 42432 - DNA, 21 bp, Artificial Sequence
  Synthetic Construct
ggggactaccaggtggcctaa

SEQ ID NO: 42433 - DNA, 21 bp, Artificial Sequence
  Synthetic Construct
cctcctctgccctgcttagat

SEQ ID NO: 42434 - DNA, 24 bp, Artificial Sequence
  Synthetic Construct
ggactaggtggtatgtagctggta

SEQ ID NO: 42435 - DNA, 25 bp, Artificial Sequence
  Synthetic Construct
ctctctacccaaggtgtcaaacact

SEQ ID NO: 42436 - DNA, 25 bp, Artificial Sequence
  Synthetic Construct
gagtaactcaaagacaggggtttgt

SEQ ID NO: 42437 - DNA, 24 bp, Artificial Sequence
  Synthetic Construct
cctctctctagaaagggaggatca

SEQ ID NO: 42438 - DNA, 20 bp, Artificial Sequence
  Synthetic Construct
tctaatggagggccgtgaca

SEQ ID NO: 42439 - DNA, 24 bp, Artificial Sequence
  Synthetic Construct
cactaacaacaacctgcagagcta

SEQ ID NO: 42440 - DNA, 21 bp, Artificial Sequence
  Synthetic Construct
tcaggcctggttcaacagttc

SEQ ID NO: 42441 - DNA, 21 bp, Artificial Sequence
  Synthetic Construct
tgggcctgcctttgcctaaga

SEQ ID NO: 42442 - DNA, 27 bp, Artificial Sequence
  Synthetic Construct
ggcaaaacagttaagtctctgtgttca

SEQ ID NO: 42443 - DNA, 21 bp, Artificial Sequence
  Synthetic Construct
gtgtgactgagcaggctttga

SEQ ID NO: 42444 - DNA, 19 bp, Artificial Sequence
  Synthetic Construct
aggcagcccaggcagtgaa

SEQ ID NO: 42445 - DNA, 20 bp, Artificial Sequence
  Synthetic Construct
gggaggaacagcccacctat

SEQ ID NO: 42446 - DNA, 21 bp, Artificial Sequence
  Synthetic Construct
ttcctggcctgggctaactct

SEQ ID NO: 42447 - DNA, 22 bp, Artificial Sequence
  Synthetic Construct
tggcaggaaggacagacgtaga

SEQ ID NO: 42448 - DNA, 20 bp, Artificial Sequence
  Synthetic Construct
gccttatggggcacagcaaa

SEQ ID NO: 42449 - DNA, 23 bp, Artificial Sequence
  Synthetic Construct
ggagcatctgtcagacccaagaa

SEQ ID NO: 42450 - DNA, 24 bp, Artificial Sequence
  Synthetic Construct
gccaaagcttaatcctaccctact

SEQ ID NO: 42451 - DNA, 24 bp, Artificial Sequence
  Synthetic Construct
tcagtcatttgtcacagtccagtt

SEQ ID NO: 42452 - DNA, 25 bp, Artificial Sequence
  Synthetic Construct
ccattacttccccttcccctgtttg

SEQ ID NO: 42453 - DNA, 19 bp, Artificial Sequence
  Synthetic Construct
tatggccagggccacagaa

SEQ ID NO: 42454 - DNA, 21 bp, Artificial Sequence
  Synthetic Construct
tcagttgtgtgctgctggtat

SEQ ID NO: 42455 - DNA, 20 bp, Artificial Sequence
  Synthetic Construct
tgtgtaacacgccagagcaa

SEQ ID NO: 42456 - DNA, 25 bp, Artificial Sequence
  Synthetic Construct
ggactatggagacgtgaaggacatt

SEQ ID NO: 42457 - DNA, 29 bp, Artificial Sequence
  Synthetic Construct
ctgacattttactcaaggtggctgtttag

SEQ ID NO: 42458 - DNA, 22 bp, Artificial Sequence
  Synthetic Construct
ccacggacagccaaagaactgt

SEQ ID NO: 42459 - DNA, 22 bp, Artificial Sequence
  Synthetic Construct
gacaaccacagccactggaaag

SEQ ID NO: 42460 - DNA, 28 bp, Artificial Sequence
  Synthetic Construct
gcagcctctctagaccttagaggtaaac

SEQ ID NO: 42461 - DNA, 20 bp, Artificial Sequence
  Synthetic Construct
tctgagcctgaagcccacta

SEQ ID NO: 42462 - DNA, 23 bp, Artificial Sequence
  Synthetic Construct
gcttaggtctcagcaagggtatg

SEQ ID NO: 42463 - DNA, 21 bp, Artificial Sequence
  Synthetic Construct
gcccacttccttgagtgatga

SEQ ID NO: 42464 - DNA, 20 bp, Artificial Sequence
  Synthetic Construct
ggccaagtgagtggacttga

SEQ ID NO: 42465 - DNA, 25 bp, Artificial Sequence
  Synthetic Construct
gggtaaaagtgagtctcatctcagt

SEQ ID NO: 42466 - DNA, 29 bp, Artificial Sequence
  Synthetic Construct
cccatgtgaaagtgggattttagctgtca

SEQ ID NO: 42467 - DNA, 22 bp, Artificial Sequence
  Synthetic Construct
agaagccattaagcccctccta

SEQ ID NO: 42468 - DNA, 27 bp, Artificial Sequence
  Synthetic Construct
ccttactcaatttacccaagcaagaga

SEQ ID NO: 42469 - DNA, 24 bp, Artificial Sequence
  Synthetic Construct
gcttggaaaagcagcaattggtaa

SEQ ID NO: 42470 - DNA, 25 bp, Artificial Sequence
  Synthetic Construct
cctagcaacaggaaaccagttcaga

SEQ ID NO: 42471 - DNA, 24 bp, Artificial Sequence
  Synthetic Construct
ggtaaagaggaagcaagacacctt

SEQ ID NO: 42472 - DNA, 26 bp, Artificial Sequence
  Synthetic Construct
gccacctgctgattgtagagtcttag

SEQ ID NO: 42473 - DNA, 21 bp, Artificial Sequence
  Synthetic Construct
gaagaccagaagcctcagcaa

SEQ ID NO: 42474 - DNA, 20 bp, Artificial Sequence
  Synthetic Construct
cagctggcttggggcttcta

SEQ ID NO: 42475 - DNA, 24 bp, Artificial Sequence
  Synthetic Construct
ccacttgtagtctgggtggtgaag

SEQ ID NO: 42476 - DNA, 24 bp, Artificial Sequence
  Synthetic Construct
gcctacatttctagggccctcact

SEQ ID NO: 42477 - DNA, 22 bp, Artificial Sequence
  Synthetic Construct
tggagtgcttaggggaggattg

SEQ ID NO: 42478 - DNA, 22 bp, Artificial Sequence
  Synthetic Construct
agggaggagaaaaggctgaaga

SEQ ID NO: 42479 - DNA, 22 bp, Artificial Sequence
  Synthetic Construct
gctgctgtccctaacccaagaa

SEQ ID NO: 42480 - DNA, 22 bp, Artificial Sequence
  Synthetic Construct
agcctaggcctggacttgaaga

SEQ ID NO: 42481 - DNA, 20 bp, Artificial Sequence
  Synthetic Construct
cagcagagtggtgggacaaa

SEQ ID NO: 42482 - DNA, 20 bp, Artificial Sequence
  Synthetic Construct
aacaccaggccagagagaca

SEQ ID NO: 42483 - DNA, 23 bp, Artificial Sequence
  Synthetic Construct
cagtcagcaagtccctccataca

SEQ ID NO: 42484 - DNA, 22 bp, Artificial Sequence
  Synthetic Construct
ggctgcttttccttgacacaac

SEQ ID NO: 42485 - DNA, 21 bp, Artificial Sequence
  Synthetic Construct
atcaacgctacaggcagtgaa

SEQ ID NO: 42486 - DNA, 24 bp, Artificial Sequence
  Synthetic Construct
gctctatccactgtggtcatgcta

SEQ ID NO: 42487 - DNA, 26 bp, Artificial Sequence
  Synthetic Construct
ccaggtggagtctgaagtgaactgat

SEQ ID NO: 42488 - DNA, 25 bp, Artificial Sequence
  Synthetic Construct
gaatctggtcatgccagtgattaca

SEQ ID NO: 42489 - DNA, 23 bp, Artificial Sequence
  Synthetic Construct
cctgtgctaggtactgggtcaac

SEQ ID NO: 42490 - DNA, 24 bp, Artificial Sequence
  Synthetic Construct
agtggaacttagcaacatggaagt

SEQ ID NO: 42491 - DNA, 18 bp, Artificial Sequence
  Synthetic Construct
tggggatggcctcagctt

SEQ ID NO: 42492 - DNA, 24 bp, Artificial Sequence
  Synthetic Construct
ctcagtaatggtggatgcccttca

SEQ ID NO: 42493 - DNA, 25 bp, Artificial Sequence
  Synthetic Construct
ctcatggggtatctcaaccactaga

SEQ ID NO: 42494 - DNA, 24 bp, Artificial Sequence
  Synthetic Construct
tggggaatatgtgccttactctca

SEQ ID NO: 42495 - DNA, 20 bp, Artificial Sequence
  Synthetic Construct
ggccaccatctttgctgctt

SEQ ID NO: 42496 - DNA, 22 bp, Artificial Sequence
  Synthetic Construct
ccttcttgtggccccagttttc

SEQ ID NO: 42497 - DNA, 25 bp, Artificial Sequence
  Synthetic Construct
tccttgtctccagaggaaagaattg

SEQ ID NO: 42498 - DNA, 22 bp, Artificial Sequence
  Synthetic Construct
ggtggtcactgtggcattgttc

SEQ ID NO: 42499 - DNA, 22 bp, Artificial Sequence
  Synthetic Construct
tctgtggggcagacaacataga

SEQ ID NO: 42500 - DNA, 24 bp, Artificial Sequence
  Synthetic Construct
cactgtatgctgatggcctgtact

SEQ ID NO: 42501 - DNA, 22 bp, Artificial Sequence
  Synthetic Construct
tcagcaccacaattggtcagaa

SEQ ID NO: 42502 - DNA, 24 bp, Artificial Sequence
  Synthetic Construct
cctatttccacatggcgctaatct

SEQ ID NO: 42503 - DNA, 23 bp, Artificial Sequence
  Synthetic Construct
ctgctaccacctcttgtggtcaa

SEQ ID NO: 42504 - DNA, 25 bp, Artificial Sequence
  Synthetic Construct
tggctcaacttacccaaggataaac

SEQ ID NO: 42505 - DNA, 22 bp, Artificial Sequence
  Synthetic Construct
cagggctccaatcctcttctct

SEQ ID NO: 42506 - DNA, 21 bp, Artificial Sequence
  Synthetic Construct
acaagaacctcccacctgact

SEQ ID NO: 42507 - DNA, 19 bp, Artificial Sequence
  Synthetic Construct
ttcgggtgggaggaaccaa

SEQ ID NO: 42508 - DNA, 22 bp, Artificial Sequence
  Synthetic Construct
ctcgcatcttttctgccagtgt

SEQ ID NO: 42509 - DNA, 20 bp, Artificial Sequence
  Synthetic Construct
gtgttatggcctgcccatct

SEQ ID NO: 42510 - DNA, 23 bp, Artificial Sequence
  Synthetic Construct
ggcaattttctgcctgtgtttct

SEQ ID NO: 42511 - DNA, 25 bp, Artificial Sequence
  Synthetic Construct
cctatgcatctggaggagctaggta

SEQ ID NO: 42512 - DNA, 21 bp, Artificial Sequence
  Synthetic Construct
tggagaatgggctgggtgttg

SEQ ID NO: 42513 - DNA, 24 bp, Artificial Sequence
  Synthetic Construct
gcctcagagtgaagacctctttga

SEQ ID NO: 42514 - DNA, 23 bp, Artificial Sequence
  Synthetic Construct
cttacctgccttcttcccctaga

SEQ ID NO: 42515 - DNA, 21 bp, Artificial Sequence
  Synthetic Construct
aagggcttgtgtttcccaagt

SEQ ID NO: 42516 - DNA, 24 bp, Artificial Sequence
  Synthetic Construct
gctcacaaaccctacacaatggat

SEQ ID NO: 42517 - DNA, 23 bp, Artificial Sequence
  Synthetic Construct
gggtgagaaccaggagagtgtga

SEQ ID NO: 42518 - DNA, 24 bp, Artificial Sequence
  Synthetic Construct
tgactaaaacaggctcagaccatt

SEQ ID NO: 42519 - DNA, 22 bp, Artificial Sequence
  Synthetic Construct
ggacaaggccaagacagtctac

SEQ ID NO: 42520 - DNA, 24 bp, Artificial Sequence
  Synthetic Construct
gtcatccacggatctctcctcttc

SEQ ID NO: 42521 - DNA, 23 bp, Artificial Sequence
  Synthetic Construct
gcgagtctgttgtgagtggatga

SEQ ID NO: 42522 - DNA, 29 bp, Artificial Sequence
  Synthetic Construct
ccctacttgttaaagtctaccccagagat

SEQ ID NO: 42523 - DNA, 21 bp, Artificial Sequence
  Synthetic Construct
acatgtcctgccaatgctcaa

SEQ ID NO: 42524 - DNA, 23 bp, Artificial Sequence
  Synthetic Construct
ggggatttgtgggagctggttac

SEQ ID NO: 42525 - DNA, 26 bp, Artificial Sequence
  Synthetic Construct
cccatatttgaccccttgtgggtgta

SEQ ID NO: 42526 - DNA, 22 bp, Artificial Sequence
  Synthetic Construct
tgatcagccttgaggcaagaga

SEQ ID NO: 42527 - DNA, 28 bp, Artificial Sequence
  Synthetic Construct
ggggtttgtattcagtctgtttgtgtag

SEQ ID NO: 42528 - DNA, 20 bp, Artificial Sequence
  Synthetic Construct
atgcctactggagccagaca

SEQ ID NO: 42529 - DNA, 21 bp, Artificial Sequence
  Synthetic Construct
gcatagcagccttcctgaact

SEQ ID NO: 42530 - DNA, 20 bp, Artificial Sequence
  Synthetic Construct
acagtgcagccaggactcaa

SEQ ID NO: 42531 - DNA, 22 bp, Artificial Sequence
  Synthetic Construct
gaggtgggtagttggcttgaac

SEQ ID NO: 42532 - DNA, 23 bp, Artificial Sequence
  Synthetic Construct
gtgatatgtgcccttcccctttg

SEQ ID NO: 42533 - DNA, 21 bp, Artificial Sequence
  Synthetic Construct
agcaccagaagagagccattg

SEQ ID NO: 42534 - DNA, 24 bp, Artificial Sequence
  Synthetic Construct
aacataccaaccgaaagacagagt

SEQ ID NO: 42535 - DNA, 20 bp, Artificial Sequence
  Synthetic Construct
tagcccatggctctgtctct

SEQ ID NO: 42536 - DNA, 21 bp, Artificial Sequence
  Synthetic Construct
gctcccatagcaacccagcta

SEQ ID NO: 42537 - DNA, 25 bp, Artificial Sequence
  Synthetic Construct
gcagttttcttctacctctggtttg

SEQ ID NO: 42538 - DNA, 25 bp, Artificial Sequence
  Synthetic Construct
tggagttaaaagggctagaaactgt

SEQ ID NO: 42539 - DNA, 25 bp, Artificial Sequence
  Synthetic Construct
cctgtagtgggtaatgtccgtgctt

SEQ ID NO: 42540 - DNA, 22 bp, Artificial Sequence
  Synthetic Construct
gtcagctcactggaccctttct

SEQ ID NO: 42541 - DNA, 22 bp, Artificial Sequence
  Synthetic Construct
ccactctctccaccaagcattc

SEQ ID NO: 42542 - DNA, 27 bp, Artificial Sequence
  Synthetic Construct
gcctatgggattagttttgaacgtaga

SEQ ID NO: 42543 - DNA, 24 bp, Artificial Sequence
  Synthetic Construct
tgctatgacttggaggtgaagact

SEQ ID NO: 42544 - DNA, 21 bp, Artificial Sequence
  Synthetic Construct
aggctgagttccaccctcttg

SEQ ID NO: 42545 - DNA, 23 bp, Artificial Sequence
  Synthetic Construct
gcaggtaatgggtggttttggaa

SEQ ID NO: 42546 - DNA, 24 bp, Artificial Sequence
  Synthetic Construct
gtgtaactctgcccctttctctac

SEQ ID NO: 42547 - DNA, 23 bp, Artificial Sequence
  Synthetic Construct
ggactgtcaaccaggaagtgttg

SEQ ID NO: 42548 - DNA, 24 bp, Artificial Sequence
  Synthetic Construct
gcacaggagacaagctgggaaatc

SEQ ID NO: 42549 - DNA, 27 bp, Artificial Sequence
  Synthetic Construct
ggaacaacaagaggggataacccaaag

SEQ ID NO: 42550 - DNA, 21 bp, Artificial Sequence
  Synthetic Construct
gagcacattccccttgcatct

SEQ ID NO: 42551 - DNA, 22 bp, Artificial Sequence
  Synthetic Construct
cggaagcacagggcatttcaga

SEQ ID NO: 42552 - DNA, 22 bp, Artificial Sequence
  Synthetic Construct
acctgtgaaggggttggggaaa

SEQ ID NO: 42553 - DNA, 23 bp, Artificial Sequence
  Synthetic Construct
ccctcaaactagggaggtagcat

SEQ ID NO: 42554 - DNA, 22 bp, Artificial Sequence
  Synthetic Construct
gctcagtcagccactcaagcta

SEQ ID NO: 42555 - DNA, 25 bp, Artificial Sequence
  Synthetic Construct
caagtcatggtcttgtcctttccta

SEQ ID NO: 42556 - DNA, 24 bp, Artificial Sequence
  Synthetic Construct
ctgcctgcatagcatgagaaatac

SEQ ID NO: 42557 - DNA, 23 bp, Artificial Sequence
  Synthetic Construct
ccacagggaaagtgtaccacgat

SEQ ID NO: 42558 - DNA, 25 bp, Artificial Sequence
  Synthetic Construct
tgagtcaatccagggaacatagtca

SEQ ID NO: 42559 - DNA, 21 bp, Artificial Sequence
  Synthetic Construct
atgtggtcctcagctcctttg

SEQ ID NO: 42560 - DNA, 23 bp, Artificial Sequence
  Synthetic Construct
ccctgttttaatggggccaaatg

SEQ ID NO: 42561 - DNA, 24 bp, Artificial Sequence
  Synthetic Construct
ttgtccacttcagcactttactct

SEQ ID NO: 42562 - DNA, 21 bp, Artificial Sequence
  Synthetic Construct
ctcaagacgccaagagcaaga

SEQ ID NO: 42563 - DNA, 23 bp, Artificial Sequence
  Synthetic Construct
cagggtgacctgaaaagctgcta

SEQ ID NO: 42564 - DNA, 22 bp, Artificial Sequence
  Synthetic Construct
ttcaccctcccttgcaatttga

SEQ ID NO: 42565 - DNA, 27 bp, Artificial Sequence
  Synthetic Construct
cccaaaagaaagcctaggacattgtga

SEQ ID NO: 42566 - DNA, 21 bp, Artificial Sequence
  Synthetic Construct
acagccctagatggccctgtt

SEQ ID NO: 42567 - DNA, 22 bp, Artificial Sequence
  Synthetic Construct
ctccaagttacgctcggtgaag

SEQ ID NO: 42568 - DNA, 21 bp, Artificial Sequence
  Synthetic Construct
cccctgcctgaaatgctgttt

SEQ ID NO: 42569 - DNA, 24 bp, Artificial Sequence
  Synthetic Construct
ggtcagcttgagctgtaacaaaca

SEQ ID NO: 42570 - DNA, 23 bp, Artificial Sequence
  Synthetic Construct
ccagaactggaactgaggctttc

SEQ ID NO: 42571 - DNA, 20 bp, Artificial Sequence
  Synthetic Construct
agaacggtgcctgctgcata

SEQ ID NO: 42572 - DNA, 21 bp, Artificial Sequence
  Synthetic Construct
tggagggtctgcttgatctct

SEQ ID NO: 42573 - DNA, 24 bp, Artificial Sequence
  Synthetic Construct
tcacctgggagtaaagttgtgatg

SEQ ID NO: 42574 - DNA, 25 bp, Artificial Sequence
  Synthetic Construct
gcccagaagagaagagtatttcaga

SEQ ID NO: 42575 - DNA, 22 bp, Artificial Sequence
  Synthetic Construct
cagttcctgggctcaagcaatc

SEQ ID NO: 42576 - DNA, 25 bp, Artificial Sequence
  Synthetic Construct
ggtatggcatcagtttctgctttca

SEQ ID NO: 42577 - DNA, 27 bp, Artificial Sequence
  Synthetic Construct
gctacaaatgagttttccccacaatct

SEQ ID NO: 42578 - DNA, 22 bp, Artificial Sequence
  Synthetic Construct
caggattgcatgcttccagtgt

SEQ ID NO: 42579 - DNA, 24 bp, Artificial Sequence
  Synthetic Construct
gcttgaatgacctgctccattttc

SEQ ID NO: 42580 - DNA, 24 bp, Artificial Sequence
  Synthetic Construct
ggccaagggagtgagagaatccaa

SEQ ID NO: 42581 - DNA, 25 bp, Artificial Sequence
  Synthetic Construct
ggcaatgaagaataccaccaacaga

SEQ ID NO: 42582 - DNA, 22 bp, Artificial Sequence
  Synthetic Construct
gacatgacctggtgggacatca

SEQ ID NO: 42583 - DNA, 20 bp, Artificial Sequence
  Synthetic Construct
atgcctgggagcgcttcatc

SEQ ID NO: 42584 - DNA, 25 bp, Artificial Sequence
  Synthetic Construct
ggccttcaagtattgacaggtcttc

SEQ ID NO: 42585 - DNA, 22 bp, Artificial Sequence
  Synthetic Construct
cagacagagggaggtgcttatg

SEQ ID NO: 42586 - DNA, 20 bp, Artificial Sequence
  Synthetic Construct
aggtggactgacaggcagaa

SEQ ID NO: 42587 - DNA, 22 bp, Artificial Sequence
  Synthetic Construct
actactgaacccctgctctaca

SEQ ID NO: 42588 - DNA, 19 bp, Artificial Sequence
  Synthetic Construct
ggggccagatcctgcattg

SEQ ID NO: 42589 - DNA, 25 bp, Artificial Sequence
  Synthetic Construct
gagctgactccatactgtcaaggaa

SEQ ID NO: 42590 - DNA, 23 bp, Artificial Sequence
  Synthetic Construct
cctggagtgtagggctgtaggat

SEQ ID NO: 42591 - DNA, 22 bp, Artificial Sequence
  Synthetic Construct
gcccatcctacagcctagcaaa

SEQ ID NO: 42592 - DNA, 21 bp, Artificial Sequence
  Synthetic Construct
agatggagtaacggggaccaa

SEQ ID NO: 42593 - DNA, 20 bp, Artificial Sequence
  Synthetic Construct
atggtgcccgggagggtctt

SEQ ID NO: 42594 - DNA, 21 bp, Artificial Sequence
  Synthetic Construct
tgggtactgcccctgcttcat

SEQ ID NO: 42595 - DNA, 22 bp, Artificial Sequence
  Synthetic Construct
gaccacacactctacaccacat

SEQ ID NO: 42596 - DNA, 25 bp, Artificial Sequence
  Synthetic Construct
ggccccagtaaaaacagtgggcatt

SEQ ID NO: 42597 - DNA, 21 bp, Artificial Sequence
  Synthetic Construct
gcctgggcaggtcatgttgtt

SEQ ID NO: 42598 - DNA, 20 bp, Artificial Sequence
  Synthetic Construct
aggggatcgcctctgattct

SEQ ID NO: 42599 - DNA, 21 bp, Artificial Sequence
  Synthetic Construct
acagggtggctactggtctca

SEQ ID NO: 42600 - DNA, 24 bp, Artificial Sequence
  Synthetic Construct
gcttaactttgcctgaaggtgaga

SEQ ID NO: 42601 - DNA, 22 bp, Artificial Sequence
  Synthetic Construct
aaagcagactcagtggggtatg

SEQ ID NO: 42602 - DNA, 21 bp, Artificial Sequence
  Synthetic Construct
caccatgtgtgtggactcgaa

SEQ ID NO: 42603 - DNA, 22 bp, Artificial Sequence
  Synthetic Construct
gcaggtgacatttgagcacgat

SEQ ID NO: 42604 - DNA, 24 bp, Artificial Sequence
  Synthetic Construct
ctcaccaaggcataaagtcagtct

SEQ ID NO: 42605 - DNA, 20 bp, Artificial Sequence
  Synthetic Construct
tggactccacctggcaaatg

SEQ ID NO: 42606 - DNA, 23 bp, Artificial Sequence
  Synthetic Construct
ccaggaaggggtaatagggctta

SEQ ID NO: 42607 - DNA, 21 bp, Artificial Sequence
  Synthetic Construct
aaggggaacacagggctgaga

SEQ ID NO: 42608 - DNA, 25 bp, Artificial Sequence
  Synthetic Construct
ctcattcactgctagtacaggttgt

SEQ ID NO: 42609 - DNA, 22 bp, Artificial Sequence
  Synthetic Construct
cttgtgtaggtgctgactccaa

SEQ ID NO: 42610 - DNA, 22 bp, Artificial Sequence
  Synthetic Construct
gtcccctacttggctgctgatt

SEQ ID NO: 42611 - DNA, 25 bp, Artificial Sequence
  Synthetic Construct
ccaaatggttttccagccagtaaag

SEQ ID NO: 42612 - DNA, 23 bp, Artificial Sequence
  Synthetic Construct
cagctgtcaatgaatggctcctt

SEQ ID NO: 42613 - DNA, 19 bp, Artificial Sequence
  Synthetic Construct
cctcgaggggaaggcatct

SEQ ID NO: 42614 - DNA, 22 bp, Artificial Sequence
  Synthetic Construct
aagcacctgtgactttgtctga

SEQ ID NO: 42615 - DNA, 22 bp, Artificial Sequence
  Synthetic Construct
ggttggaggagagtgtggatgt

SEQ ID NO: 42616 - DNA, 20 bp, Artificial Sequence
  Synthetic Construct
tggggctgtgggactagtgt

SEQ ID NO: 42617 - DNA, 20 bp, Artificial Sequence
  Synthetic Construct
gtggtgacaggacgtggttt

SEQ ID NO: 42618 - DNA, 24 bp, Artificial Sequence
  Synthetic Construct
atccgaactaaccattcactgtgt

SEQ ID NO: 42619 - DNA, 21 bp, Artificial Sequence
  Synthetic Construct
tctctcacagttgggcaggat

SEQ ID NO: 42620 - DNA, 22 bp, Artificial Sequence
  Synthetic Construct
gctgcagtagtccttcctgtct

SEQ ID NO: 42621 - DNA, 20 bp, Artificial Sequence
  Synthetic Construct
ccaggcaactttcccagaca

SEQ ID NO: 42622 - DNA, 25 bp, Artificial Sequence
  Synthetic Construct
ccaaaagtgggttgaagccagatca

SEQ ID NO: 42623 - DNA, 21 bp, Artificial Sequence
  Synthetic Construct
tgcctgcacatcagtgattct

SEQ ID NO: 42624 - DNA, 27 bp, Artificial Sequence
  Synthetic Construct
gtggctattaatcaagatctcgtgcta

SEQ ID NO: 42625 - DNA, 22 bp, Artificial Sequence
  Synthetic Construct
ctgcctcccatctgccatgata

SEQ ID NO: 42626 - DNA, 20 bp, Artificial Sequence
  Synthetic Construct
aaaagccccagcggtgtttg

SEQ ID NO: 42627 - DNA, 20 bp, Artificial Sequence
  Synthetic Construct
gcacagcactgggctttgtt

SEQ ID NO: 42628 - DNA, 23 bp, Artificial Sequence
  Synthetic Construct
cagacagtattcctggccctgta

SEQ ID NO: 42629 - DNA, 22 bp, Artificial Sequence
  Synthetic Construct
caggctggtacctacggattga

SEQ ID NO: 42630 - DNA, 26 bp, Artificial Sequence
  Synthetic Construct
cctctttaggttttggggagaaaaca

SEQ ID NO: 42631 - DNA, 20 bp, Artificial Sequence
  Synthetic Construct
cccagccaggaactttgtca

SEQ ID NO: 42632 - DNA, 23 bp, Artificial Sequence
  Synthetic Construct
ttttgcccttctgtcccttatgt

SEQ ID NO: 42633 - DNA, 22 bp, Artificial Sequence
  Synthetic Construct
gcttgctcacagggtggacatt

SEQ ID NO: 42634 - DNA, 21 bp, Artificial Sequence
  Synthetic Construct
tgatcagagaggcaggtgtga

SEQ ID NO: 42635 - DNA, 25 bp, Artificial Sequence
  Synthetic Construct
gcatctcagtctcccatctttgtgt

SEQ ID NO: 42636 - DNA, 24 bp, Artificial Sequence
  Synthetic Construct
cagggatttgagtccagctgttca

SEQ ID NO: 42637 - DNA, 25 bp, Artificial Sequence
  Synthetic Construct
ggcttggtttttcacttcaggttag

SEQ ID NO: 42638 - DNA, 24 bp, Artificial Sequence
  Synthetic Construct
ggacatcctccctagcaacaccaa

SEQ ID NO: 42639 - DNA, 23 bp, Artificial Sequence
  Synthetic Construct
ggaactcagagccctatggaaag

SEQ ID NO: 42640 - DNA, 25 bp, Artificial Sequence
  Synthetic Construct
ccttctattggcagagaaagtctga

SEQ ID NO: 42641 - DNA, 26 bp, Artificial Sequence
  Synthetic Construct
gacaggttgcttgaaataccctctca

SEQ ID NO: 42642 - DNA, 22 bp, Artificial Sequence
  Synthetic Construct
gtgactgatgggcaggtagcat

SEQ ID NO: 42643 - DNA, 20 bp, Artificial Sequence
  Synthetic Construct
gggagaggccaacagaccaa

SEQ ID NO: 42644 - DNA, 20 bp, Artificial Sequence
  Synthetic Construct
gctccagggagctctaggat

SEQ ID NO: 42645 - DNA, 22 bp, Artificial Sequence
  Synthetic Construct
gggcaaggaagtgggtctttga

SEQ ID NO: 42646 - DNA, 20 bp, Artificial Sequence
  Synthetic Construct
tgcaggactgctgccaggat

SEQ ID NO: 42647 - DNA, 20 bp, Artificial Sequence
  Synthetic Construct
gctgtggcaggtttggtgtt

SEQ ID NO: 42648 - DNA, 24 bp, Artificial Sequence
  Synthetic Construct
gcactcccaagtccagttctaaag

SEQ ID NO: 42649 - DNA, 24 bp, Artificial Sequence
  Synthetic Construct
ctttccaccacttcccatctttct

SEQ ID NO: 42650 - DNA, 27 bp, Artificial Sequence
  Synthetic Construct
ctggagtaaaatgctttaggaccaagt

SEQ ID NO: 42651 - DNA, 25 bp, Artificial Sequence
  Synthetic Construct
aggtaagaaaattggggctcaaaca

SEQ ID NO: 42652 - DNA, 21 bp, Artificial Sequence
  Synthetic Construct
agcaacccctatccccagcaa

SEQ ID NO: 42653 - DNA, 22 bp, Artificial Sequence
  Synthetic Construct
ccctcctgcctgaaacaaccaa

SEQ ID NO: 42654 - DNA, 22 bp, Artificial Sequence
  Synthetic Construct
gggttgttcaccctggaaccta

SEQ ID NO: 42655 - DNA, 23 bp, Artificial Sequence
  Synthetic Construct
gaggggactttaaacctgcagaa

SEQ ID NO: 42656 - DNA, 24 bp, Artificial Sequence
  Synthetic Construct
ggtgaagtctatgctgaccaagtt

SEQ ID NO: 42657 - DNA, 24 bp, Artificial Sequence
  Synthetic Construct
gctttaacttgcctcccagacctt

SEQ ID NO: 42658 - DNA, 28 bp, Artificial Sequence
  Synthetic Construct
ccatctacagacactaaggtagcctctt

SEQ ID NO: 42659 - DNA, 24 bp, Artificial Sequence
  Synthetic Construct
ccctctcttgggcctcagaaaact

SEQ ID NO: 42660 - DNA, 27 bp, Artificial Sequence
  Synthetic Construct
gactgatgatgcaagaaaggcataaac

SEQ ID NO: 42661 - DNA, 23 bp, Artificial Sequence
  Synthetic Construct
ccccagctgtatgttgcaaggtt

SEQ ID NO: 42662 - DNA, 22 bp, Artificial Sequence
  Synthetic Construct
ccagagggaagcagttggaaga

SEQ ID NO: 42663 - DNA, 24 bp, Artificial Sequence
  Synthetic Construct
tttgaaatggcagtgtctgggata

SEQ ID NO: 42664 - DNA, 23 bp, Artificial Sequence
  Synthetic Construct
gcaaatcctggccctactgaaac

SEQ ID NO: 42665 - DNA, 20 bp, Artificial Sequence
  Synthetic Construct
cacctgggcctgaacatcaa

SEQ ID NO: 42666 - DNA, 24 bp, Artificial Sequence
  Synthetic Construct
cactgaagccaaaagccatacaca

SEQ ID NO: 42667 - DNA, 19 bp, Artificial Sequence
  Synthetic Construct
ggctgtgggcgcagataca

SEQ ID NO: 42668 - DNA, 26 bp, Artificial Sequence
  Synthetic Construct
caagaatcctatcctgggaagacaga

SEQ ID NO: 42669 - DNA, 20 bp, Artificial Sequence
  Synthetic Construct
tccacatggggcagcttgaa

SEQ ID NO: 42670 - DNA, 19 bp, Artificial Sequence
  Synthetic Construct
acgggtgtggagcttgtgt

SEQ ID NO: 42671 - DNA, 24 bp, Artificial Sequence
  Synthetic Construct
ccacaatgtgctttgtcccttttc

SEQ ID NO: 42672 - DNA, 26 bp, Artificial Sequence
  Synthetic Construct
ctgaggatgggaaagctgtttcttct

SEQ ID NO: 42673 - DNA, 25 bp, Artificial Sequence
  Synthetic Construct
gttatcattctttggccctccattc

SEQ ID NO: 42674 - DNA, 23 bp, Artificial Sequence
  Synthetic Construct
ggggcaatatagtagcccagaca

SEQ ID NO: 42675 - DNA, 20 bp, Artificial Sequence
  Synthetic Construct
acctactgcccatgcactga

SEQ ID NO: 42676 - DNA, 23 bp, Artificial Sequence
  Synthetic Construct
ctggtcacagcaacctctgattc

SEQ ID NO: 42677 - DNA, 21 bp, Artificial Sequence
  Synthetic Construct
ctctgggcccatttcagcatt

SEQ ID NO: 42678 - DNA, 24 bp, Artificial Sequence
  Synthetic Construct
tgacattgccatcttcacaggaat

SEQ ID NO: 42679 - DNA, 28 bp, Artificial Sequence
  Synthetic Construct
ggcagtttcatttaaggctgactgattc

SEQ ID NO: 42680 - DNA, 21 bp, Artificial Sequence
  Synthetic Construct
gcctgtccaagccctaccaat

SEQ ID NO: 42681 - DNA, 22 bp, Artificial Sequence
  Synthetic Construct
accgaggttcagagaggagaag

SEQ ID NO: 42682 - DNA, 23 bp, Artificial Sequence
  Synthetic Construct
ggtcttgccttatcctgcttttg

SEQ ID NO: 42683 - DNA, 24 bp, Artificial Sequence
  Synthetic Construct
cccatgtgagtccttgtggtccaa

SEQ ID NO: 42684 - DNA, 22 bp, Artificial Sequence
  Synthetic Construct
ccacagtgggttagagcatcaa

SEQ ID NO: 42685 - DNA, 25 bp, Artificial Sequence
  Synthetic Construct
ctggcatggattgtagttgctgaac

SEQ ID NO: 42686 - DNA, 22 bp, Artificial Sequence
  Synthetic Construct
cttctggggaaaccccacctaa

SEQ ID NO: 42687 - DNA, 21 bp, Artificial Sequence
  Synthetic Construct
atgtgagggaggggctggttt

SEQ ID NO: 42688 - DNA, 23 bp, Artificial Sequence
  Synthetic Construct
agtccaacaaacagtgagggaaa

SEQ ID NO: 42689 - DNA, 26 bp, Artificial Sequence
  Synthetic Construct
cagacaccaggactttcttgctgtta

SEQ ID NO: 42690 - DNA, 21 bp, Artificial Sequence
  Synthetic Construct
tcatgcccaccttggaacatc

SEQ ID NO: 42691 - DNA, 23 bp, Artificial Sequence
  Synthetic Construct
gggaggtgagggtcttggtgtaa

SEQ ID NO: 42692 - DNA, 20 bp, Artificial Sequence
  Synthetic Construct
gtgcttccagaggcaaccaa

SEQ ID NO: 42693 - DNA, 27 bp, Artificial Sequence
  Synthetic Construct
gctgcaattccagatgtggtttcattc

SEQ ID NO: 42694 - DNA, 23 bp, Artificial Sequence
  Synthetic Construct
gctccattctgggatggggaaag

SEQ ID NO: 42695 - DNA, 23 bp, Artificial Sequence
  Synthetic Construct
gtctgaagcttggtgcttacaac

SEQ ID NO: 42696 - DNA, 22 bp, Artificial Sequence
  Synthetic Construct
cggggagtagacctgcttgtat

SEQ ID NO: 42697 - DNA, 25 bp, Artificial Sequence
  Synthetic Construct
gacctttgatggactggacttctac

SEQ ID NO: 42698 - DNA, 23 bp, Artificial Sequence
  Synthetic Construct
ccaatcaggtctgtgttcgattg

SEQ ID NO: 42699 - DNA, 26 bp, Artificial Sequence
  Synthetic Construct
gtgccattacaatgaactaccactgt

SEQ ID NO: 42700 - DNA, 23 bp, Artificial Sequence
  Synthetic Construct
cgctgtatgaatggcttgcttga

SEQ ID NO: 42701 - DNA, 24 bp, Artificial Sequence
  Synthetic Construct
gggatagagagtttgcactgagtt

SEQ ID NO: 42702 - DNA, 26 bp, Artificial Sequence
  Synthetic Construct
gacaaaaggctaagaggggagaaatg

SEQ ID NO: 42703 - DNA, 19 bp, Artificial Sequence
  Synthetic Construct
agggtggccaggctagaaa

SEQ ID NO: 42704 - DNA, 21 bp, Artificial Sequence
  Synthetic Construct
ccctttgtccagccccaacat

SEQ ID NO: 42705 - DNA, 21 bp, Artificial Sequence
  Synthetic Construct
gggaggcaaatctctggcaaa

SEQ ID NO: 42706 - DNA, 23 bp, Artificial Sequence
  Synthetic Construct
ccagggatatgggctctgtctac

SEQ ID NO: 42707 - DNA, 24 bp, Artificial Sequence
  Synthetic Construct
gggaagaaggcaaggaaatacact

SEQ ID NO: 42708 - DNA, 23 bp, Artificial Sequence
  Synthetic Construct
ccaggacctagggccaaatttca

SEQ ID NO: 42709 - DNA, 27 bp, Artificial Sequence
  Synthetic Construct
cgcttctttacacttccaactctgctt

SEQ ID NO: 42710 - DNA, 27 bp, Artificial Sequence
  Synthetic Construct
ggactttctaatatgtgtcggctctgt

SEQ ID NO: 42711 - DNA, 26 bp, Artificial Sequence
  Synthetic Construct
ctttagtaaaacagcccaggaagaag

SEQ ID NO: 42712 - DNA, 22 bp, Artificial Sequence
  Synthetic Construct
gatgtgtgcagacttggtccat

SEQ ID NO: 42713 - DNA, 22 bp, Artificial Sequence
  Synthetic Construct
ctggagggagaggggcaaatta

SEQ ID NO: 42714 - DNA, 23 bp, Artificial Sequence
  Synthetic Construct
gactgtgcattcagtctcctttg

SEQ ID NO: 42715 - DNA, 25 bp, Artificial Sequence
  Synthetic Construct
gagtgctgtcatcctaacaccatag

SEQ ID NO: 42716 - DNA, 22 bp, Artificial Sequence
  Synthetic Construct
aggcttttctctccctctgttg

SEQ ID NO: 42717 - DNA, 24 bp, Artificial Sequence
  Synthetic Construct
ccacccctttacttggagttggta

SEQ ID NO: 42718 - DNA, 24 bp, Artificial Sequence
  Synthetic Construct
ctcagtggagatgagtttgcaatg

SEQ ID NO: 42719 - DNA, 22 bp, Artificial Sequence
  Synthetic Construct
ggtgactgagagtggggagact

SEQ ID NO: 42720 - DNA, 22 bp, Artificial Sequence
  Synthetic Construct
tcctggtggtcatccctgaaac

SEQ ID NO: 42721 - DNA, 22 bp, Artificial Sequence
  Synthetic Construct
ccagagacaggaggaagagcaa

SEQ ID NO: 42722 - DNA, 24 bp, Artificial Sequence
  Synthetic Construct
cctcactgaagtcagaaccaggta

SEQ ID NO: 42723 - DNA, 21 bp, Artificial Sequence
  Synthetic Construct
acaggtccgaaaagccattgt

SEQ ID NO: 42724 - DNA, 23 bp, Artificial Sequence
  Synthetic Construct
cctctggggtcacacttatctct

SEQ ID NO: 42725 - DNA, 21 bp, Artificial Sequence
  Synthetic Construct
cctgctgtaaacctggccaaa

SEQ ID NO: 42726 - DNA, 24 bp, Artificial Sequence
  Synthetic Construct
gctaggcaagggtatggaggttca

SEQ ID NO: 42727 - DNA, 20 bp, Artificial Sequence
  Synthetic Construct
tgggactgggccacagaact

SEQ ID NO: 42728 - DNA, 22 bp, Artificial Sequence
  Synthetic Construct
cccatccccacactcctctaca

SEQ ID NO: 42729 - DNA, 24 bp, Artificial Sequence
  Synthetic Construct
cctgagcacaacactgatggtctt

SEQ ID NO: 42730 - DNA, 22 bp, Artificial Sequence
  Synthetic Construct
ttggagggccaggagctacaga

SEQ ID NO: 42731 - DNA, 24 bp, Artificial Sequence
  Synthetic Construct
cccaaggctataaggggtgcttag

SEQ ID NO: 42732 - DNA, 27 bp, Artificial Sequence
  Synthetic Construct
ctgaagacatgtacatctgctctttga

SEQ ID NO: 42733 - DNA, 22 bp, Artificial Sequence
  Synthetic Construct
ggccctttttacaggccctaac

SEQ ID NO: 42734 - DNA, 22 bp, Artificial Sequence
  Synthetic Construct
cgtccctctgcttaaggggaaa

SEQ ID NO: 42735 - DNA, 19 bp, Artificial Sequence
  Synthetic Construct
tccctccctgcccttcaga

SEQ ID NO: 42736 - DNA, 24 bp, Artificial Sequence
  Synthetic Construct
gtcataaacatacgggcagccttt

SEQ ID NO: 42737 - DNA, 23 bp, Artificial Sequence
  Synthetic Construct
gctccttggctgtgtaactgtga

SEQ ID NO: 42738 - DNA, 19 bp, Artificial Sequence
  Synthetic Construct
cggaggtgcgctccataag

SEQ ID NO: 42739 - DNA, 21 bp, Artificial Sequence
  Synthetic Construct
gaagctcaagcccggtaagat

SEQ ID NO: 42740 - DNA, 20 bp, Artificial Sequence
  Synthetic Construct
tgagtcccagggcacccaat

SEQ ID NO: 42741 - DNA, 29 bp, Artificial Sequence
  Synthetic Construct
ggagaacaatactttcccttttggagtag

SEQ ID NO: 42742 - DNA, 30 bp, Artificial Sequence
  Synthetic Construct
ggagctttaattgtctctcaccatccctta

SEQ ID NO: 42743 - DNA, 20 bp, Artificial Sequence
  Synthetic Construct
cgtggcaaggcacaagtgaa

SEQ ID NO: 42744 - DNA, 21 bp, Artificial Sequence
  Synthetic Construct
gacacagtgggatgtgtggtt

SEQ ID NO: 42745 - DNA, 24 bp, Artificial Sequence
  Synthetic Construct
cctctcgccaccatcttgctacta

SEQ ID NO: 42746 - DNA, 19 bp, Artificial Sequence
  Synthetic Construct
ggcccaggcagtagagtca

SEQ ID NO: 42747 - DNA, 24 bp, Artificial Sequence
  Synthetic Construct
ctagatgtcactgcctccctttac

SEQ ID NO: 42748 - DNA, 30 bp, Artificial Sequence
  Synthetic Construct
ccagtttctcagtaaaacaatgcctgttac

SEQ ID NO: 42749 - DNA, 24 bp, Artificial Sequence
  Synthetic Construct
cgtgctgtctgcaaacaacgtcta

SEQ ID NO: 42750 - DNA, 22 bp, Artificial Sequence
  Synthetic Construct
gaggaacaggaggcaagtgttg

SEQ ID NO: 42751 - DNA, 24 bp, Artificial Sequence
  Synthetic Construct
ggcaggcctgataacaggttgtgt

SEQ ID NO: 42752 - DNA, 20 bp, Artificial Sequence
  Synthetic Construct
gcaagctggccatcctgtag

SEQ ID NO: 42753 - DNA, 20 bp, Artificial Sequence
  Synthetic Construct
tccccttacccaggttgcat

SEQ ID NO: 42754 - DNA, 25 bp, Artificial Sequence
  Synthetic Construct
gtcctgaaagcttttggctccattc

SEQ ID NO: 42755 - DNA, 20 bp, Artificial Sequence
  Synthetic Construct
gtgttggtctcggccttgaa

SEQ ID NO: 42756 - DNA, 28 bp, Artificial Sequence
  Synthetic Construct
gccagagttctaccctatctaatgaatc

SEQ ID NO: 42757 - DNA, 21 bp, Artificial Sequence
  Synthetic Construct
accacaggcagatgagcaaag

SEQ ID NO: 42758 - DNA, 25 bp, Artificial Sequence
  Synthetic Construct
gtggcatacacttgtagtcccatct

SEQ ID NO: 42759 - DNA, 24 bp, Artificial Sequence
  Synthetic Construct
gcagctcttacttaggcctccaaa

SEQ ID NO: 42760 - DNA, 22 bp, Artificial Sequence
  Synthetic Construct
tgcaacctctcttcctcctctt

SEQ ID NO: 42761 - DNA, 20 bp, Artificial Sequence
  Synthetic Construct
gcaggttgaaggcagcagtt

SEQ ID NO: 42762 - DNA, 19 bp, Artificial Sequence
  Synthetic Construct
aagcaacctcgggccacaa

SEQ ID NO: 42763 - DNA, 23 bp, Artificial Sequence
  Synthetic Construct
tgtcctgtcctgaattgggaatg

SEQ ID NO: 42764 - DNA, 28 bp, Artificial Sequence
  Synthetic Construct
ggatgtactttgtttcaaggcagcatag

SEQ ID NO: 42765 - DNA, 20 bp, Artificial Sequence
  Synthetic Construct
atcccatgggtgtgcgatgt

SEQ ID NO: 42766 - DNA, 26 bp, Artificial Sequence
  Synthetic Construct
tcttcatctctggagagctgtactat

SEQ ID NO: 42767 - DNA, 22 bp, Artificial Sequence
  Synthetic Construct
cagcaatgtgcgaaacacaaac

SEQ ID NO: 42768 - DNA, 26 bp, Artificial Sequence
  Synthetic Construct
gggaattttcctcaggggaatgaact

SEQ ID NO: 42769 - DNA, 20 bp, Artificial Sequence
  Synthetic Construct
cacccaggaaggtgcagaaa

SEQ ID NO: 42770 - DNA, 21 bp, Artificial Sequence
  Synthetic Construct
tgcacctccagtctcagctat

SEQ ID NO: 42771 - DNA, 21 bp, Artificial Sequence
  Synthetic Construct
tcctgccctgtgctgttctca

SEQ ID NO: 42772 - DNA, 22 bp, Artificial Sequence
  Synthetic Construct
ttgtgtacatgcccaaggctat

SEQ ID NO: 42773 - DNA, 22 bp, Artificial Sequence
  Synthetic Construct
gcctggtattcaagggctccat

SEQ ID NO: 42774 - DNA, 24 bp, Artificial Sequence
  Synthetic Construct
gatatattcgggcaggactgttgt

SEQ ID NO: 42775 - DNA, 25 bp, Artificial Sequence
  Synthetic Construct
cccctctaaggtctttgagcagcta

SEQ ID NO: 42776 - DNA, 25 bp, Artificial Sequence
  Synthetic Construct
ctgaagagggtgtagtcgtttgctt

SEQ ID NO: 42777 - DNA, 20 bp, Artificial Sequence
  Synthetic Construct
ggccatcacagccagaaagt

SEQ ID NO: 42778 - DNA, 24 bp, Artificial Sequence
  Synthetic Construct
cggaaaatgctagggaaggtgtct

SEQ ID NO: 42779 - DNA, 27 bp, Artificial Sequence
  Synthetic Construct
actacgtgtaggtgaattgaacgatag

SEQ ID NO: 42780 - DNA, 24 bp, Artificial Sequence
  Synthetic Construct
gaaaggagtgctacccagagatag

SEQ ID NO: 42781 - DNA, 20 bp, Artificial Sequence
  Synthetic Construct
cagttctgcgctgaccaagt

SEQ ID NO: 42782 - DNA, 22 bp, Artificial Sequence
  Synthetic Construct
cacctgcgggcctttatactca

SEQ ID NO: 42783 - DNA, 21 bp, Artificial Sequence
  Synthetic Construct
gagacctttgagggcatgcaa

SEQ ID NO: 42784 - DNA, 23 bp, Artificial Sequence
  Synthetic Construct
aggggaaaagcatcccatctttc

SEQ ID NO: 42785 - DNA, 26 bp, Artificial Sequence
  Synthetic Construct
gggcaaaaggatcagaaaagtctaag

SEQ ID NO: 42786 - DNA, 22 bp, Artificial Sequence
  Synthetic Construct
ggctgagtaggtttgtgacgat

SEQ ID NO: 42787 - DNA, 24 bp, Artificial Sequence
  Synthetic Construct
ctgagatcttgtagcccagcctta

SEQ ID NO: 42788 - DNA, 22 bp, Artificial Sequence
  Synthetic Construct
acgtaccctacaccagacaaca

SEQ ID NO: 42789 - DNA, 20 bp, Artificial Sequence
  Synthetic Construct
gcagagttgtggcagcacta

SEQ ID NO: 42790 - DNA, 26 bp, Artificial Sequence
  Synthetic Construct
gattatctggatgccccttaggtaac

SEQ ID NO: 42791 - DNA, 23 bp, Artificial Sequence
  Synthetic Construct
gctttctatggctgatgctctct

SEQ ID NO: 42792 - DNA, 22 bp, Artificial Sequence
  Synthetic Construct
ctgctgggtgtttgatcaccat

SEQ ID NO: 42793 - DNA, 21 bp, Artificial Sequence
  Synthetic Construct
gccacatccacacctgctcaa

SEQ ID NO: 42794 - DNA, 22 bp, Artificial Sequence
  Synthetic Construct
tgtgtagacagaggtgcctgtt

SEQ ID NO: 42795 - DNA, 25 bp, Artificial Sequence
  Synthetic Construct
gccacctcaataccctttcgactct

SEQ ID NO: 42796 - DNA, 22 bp, Artificial Sequence
  Synthetic Construct
tccacttcctcctcccagaaac

SEQ ID NO: 42797 - DNA, 24 bp, Artificial Sequence
  Synthetic Construct
gctaaaaagttagcctgccaccat

SEQ ID NO: 42798 - DNA, 22 bp, Artificial Sequence
  Synthetic Construct
cggcatcactgtgacaccaaag

SEQ ID NO: 42799 - DNA, 25 bp, Artificial Sequence
  Synthetic Construct
cctttatgtaagcagggtcggaatg

SEQ ID NO: 42800 - DNA, 21 bp, Artificial Sequence
  Synthetic Construct
gagatgggccagagagcattc

SEQ ID NO: 42801 - DNA, 22 bp, Artificial Sequence
  Synthetic Construct
gtgtgtttccaggagccagact

SEQ ID NO: 42802 - DNA, 22 bp, Artificial Sequence
  Synthetic Construct
actccgatgggtagaagccatt

SEQ ID NO: 42803 - DNA, 25 bp, Artificial Sequence
  Synthetic Construct
gactaactactctgtgccagtcctt

SEQ ID NO: 42804 - DNA, 19 bp, Artificial Sequence
  Synthetic Construct
agatggcaccagcctctgt

SEQ ID NO: 42805 - DNA, 23 bp, Artificial Sequence
  Synthetic Construct
gacttggcaagctctgggatcat

SEQ ID NO: 42806 - DNA, 23 bp, Artificial Sequence
  Synthetic Construct
ctcatgtagcatgacgcttctgt

SEQ ID NO: 42807 - DNA, 22 bp, Artificial Sequence
  Synthetic Construct
agtggttcgcctctctgtactt

SEQ ID NO: 42808 - DNA, 20 bp, Artificial Sequence
  Synthetic Construct
tcccttctcctcccctctca

SEQ ID NO: 42809 - DNA, 22 bp, Artificial Sequence
  Synthetic Construct
agacagggtctcgtcacatttc

SEQ ID NO: 42810 - DNA, 24 bp, Artificial Sequence
  Synthetic Construct
ggccttggttgattccagcagcat

SEQ ID NO: 42811 - DNA, 27 bp, Artificial Sequence
  Synthetic Construct
gctaaataaggaaagggtactgggatt

SEQ ID NO: 42812 - DNA, 20 bp, Artificial Sequence
  Synthetic Construct
tgggcatgaaccctgagcta

SEQ ID NO: 42813 - DNA, 22 bp, Artificial Sequence
  Synthetic Construct
gatcttcggtccctcaggtttg

SEQ ID NO: 42814 - DNA, 23 bp, Artificial Sequence
  Synthetic Construct
gggcttggatctttgtcgtcact

SEQ ID NO: 42815 - DNA, 20 bp, Artificial Sequence
  Synthetic Construct
gtgggcgcttttgcttcttg

SEQ ID NO: 42816 - DNA, 23 bp, Artificial Sequence
  Synthetic Construct
tccgggcagggagtagaagacta

SEQ ID NO: 42817 - DNA, 25 bp, Artificial Sequence
  Synthetic Construct
gaaggctaaatgagctgggaatttg

SEQ ID NO: 42818 - DNA, 25 bp, Artificial Sequence
  Synthetic Construct
tgagatgcttatcaccacaggtttc

SEQ ID NO: 42819 - DNA, 21 bp, Artificial Sequence
  Synthetic Construct
acatgcaccctggaggtcaga

SEQ ID NO: 42820 - DNA, 19 bp, Artificial Sequence
  Synthetic Construct
ggctgtggacgaggagtgt

SEQ ID NO: 42821 - DNA, 20 bp, Artificial Sequence
  Synthetic Construct
tggcatcccttgcagtctgt

SEQ ID NO: 42822 - DNA, 20 bp, Artificial Sequence
  Synthetic Construct
gcactccctctccaggtaca

SEQ ID NO: 42823 - DNA, 23 bp, Artificial Sequence
  Synthetic Construct
gagttttcccggttaccgtcttc

SEQ ID NO: 42824 - DNA, 18 bp, Artificial Sequence
  Synthetic Construct
tggtgaggagggcagcat

SEQ ID NO: 42825 - DNA, 25 bp, Artificial Sequence
  Synthetic Construct
gtgttaagcatgttgccaaaagttg

SEQ ID NO: 42826 - DNA, 22 bp, Artificial Sequence
  Synthetic Construct
tccattctcccacacgctaaag

SEQ ID NO: 42827 - DNA, 21 bp, Artificial Sequence
  Synthetic Construct
ttctgttgccaagccctctac

SEQ ID NO: 42828 - DNA, 20 bp, Artificial Sequence
  Synthetic Construct
tctgccctgcctttcaccaa

SEQ ID NO: 42829 - DNA, 21 bp, Artificial Sequence
  Synthetic Construct
catcctggtttgccgatggtt

SEQ ID NO: 42830 - DNA, 18 bp, Artificial Sequence
  Synthetic Construct
tgaggccactggggttga

SEQ ID NO: 42831 - DNA, 21 bp, Artificial Sequence
  Synthetic Construct
aacttcccctcctgcccattg

SEQ ID NO: 42832 - DNA, 26 bp, Artificial Sequence
  Synthetic Construct
cctactcacccatttatgaccacctt

SEQ ID NO: 42833 - DNA, 22 bp, Artificial Sequence
  Synthetic Construct
gcaatggagtggagctgtttgt

SEQ ID NO: 42834 - DNA, 22 bp, Artificial Sequence
  Synthetic Construct
tgagggtaaacaggggttctga

SEQ ID NO: 42835 - DNA, 22 bp, Artificial Sequence
  Synthetic Construct
cagtaaccagaagccgctctac

SEQ ID NO: 42836 - DNA, 20 bp, Artificial Sequence
  Synthetic Construct
gtgttgcctgtccagtctca

SEQ ID NO: 42837 - DNA, 25 bp, Artificial Sequence
  Synthetic Construct
aaggatatgatgggtgcattgtagt

SEQ ID NO: 42838 - DNA, 21 bp, Artificial Sequence
  Synthetic Construct
tgagctcagggaagcaagaga

SEQ ID NO: 42839 - DNA, 25 bp, Artificial Sequence
  Synthetic Construct
accccaggttgagaataacttcttt

SEQ ID NO: 42840 - DNA, 23 bp, Artificial Sequence
  Synthetic Construct
ggcttagctactttgagctgctt

SEQ ID NO: 42841 - DNA, 22 bp, Artificial Sequence
  Synthetic Construct
ttctcctgcccttaccagtttc

SEQ ID NO: 42842 - DNA, 25 bp, Artificial Sequence
  Synthetic Construct
gcgatgggacagttttcgagttatc

SEQ ID NO: 42843 - DNA, 22 bp, Artificial Sequence
  Synthetic Construct
gaaggttcattcctccctgcaa

SEQ ID NO: 42844 - DNA, 25 bp, Artificial Sequence
  Synthetic Construct
cccacacacttcttgcagctgtact

SEQ ID NO: 42845 - DNA, 23 bp, Artificial Sequence
  Synthetic Construct
ccccatcactcactctggctcta

SEQ ID NO: 42846 - DNA, 18 bp, Artificial Sequence
  Synthetic Construct
tgggcaacgtggggtcaa

SEQ ID NO: 42847 - DNA, 20 bp, Artificial Sequence
  Synthetic Construct
ggtgcatggcatagcggaaa

SEQ ID NO: 42848 - DNA, 22 bp, Artificial Sequence
  Synthetic Construct
gctgaggaaaggcagactgtga

SEQ ID NO: 42849 - DNA, 25 bp, Artificial Sequence
  Synthetic Construct
gacacttggccattggaacctagaa

SEQ ID NO: 42850 - DNA, 22 bp, Artificial Sequence
  Synthetic Construct
ttccagggccacactactccat

SEQ ID NO: 42851 - DNA, 26 bp, Artificial Sequence
  Synthetic Construct
gtctctgtcatcacagtcacagaact

SEQ ID NO: 42852 - DNA, 22 bp, Artificial Sequence
  Synthetic Construct
cacacctctcacccttggctat

SEQ ID NO: 42853 - DNA, 20 bp, Artificial Sequence
  Synthetic Construct
tcccaggaagctgccttttg

SEQ ID NO: 42854 - DNA, 20 bp, Artificial Sequence
  Synthetic Construct
cccttccagttccccacaga

SEQ ID NO: 42855 - DNA, 24 bp, Artificial Sequence
  Synthetic Construct
ggaatcttgcagctcatcctgtca

SEQ ID NO: 42856 - DNA, 26 bp, Artificial Sequence
  Synthetic Construct
gttagtgaagcagtcctgtgtaacat

SEQ ID NO: 42857 - DNA, 24 bp, Artificial Sequence
  Synthetic Construct
gatggcatacgaccagaagaaaag

SEQ ID NO: 42858 - DNA, 24 bp, Artificial Sequence
  Synthetic Construct
gacctaagggagcttgctttctct

SEQ ID NO: 42859 - DNA, 22 bp, Artificial Sequence
  Synthetic Construct
cccagtggacaagtacctggtt

SEQ ID NO: 42860 - DNA, 19 bp, Artificial Sequence
  Synthetic Construct
tgggccacagctcccagaa

SEQ ID NO: 42861 - DNA, 24 bp, Artificial Sequence
  Synthetic Construct
gagacaggagccactggaattttg

SEQ ID NO: 42862 - DNA, 22 bp, Artificial Sequence
  Synthetic Construct
gtactgtgtgtggctcatggta

SEQ ID NO: 42863 - DNA, 22 bp, Artificial Sequence
  Synthetic Construct
aggtcccaagactgtggcttca

SEQ ID NO: 42864 - DNA, 23 bp, Artificial Sequence
  Synthetic Construct
tcttgagaccaactctcctccaa

SEQ ID NO: 42865 - DNA, 21 bp, Artificial Sequence
  Synthetic Construct
gcgctcagattacacgcgatt

SEQ ID NO: 42866 - DNA, 24 bp, Artificial Sequence
  Synthetic Construct
acagctgtgaaggtattgaaggaa

SEQ ID NO: 42867 - DNA, 22 bp, Artificial Sequence
  Synthetic Construct
ggagcaggaggaggaatcaatg

SEQ ID NO: 42868 - DNA, 22 bp, Artificial Sequence
  Synthetic Construct
gcccaggtctgctagggttaaa

SEQ ID NO: 42869 - DNA, 21 bp, Artificial Sequence
  Synthetic Construct
ccatcctcagcacagccatca

SEQ ID NO: 42870 - DNA, 25 bp, Artificial Sequence
  Synthetic Construct
cagacaggttgagatgtgcctatac

SEQ ID NO: 42871 - DNA, 23 bp, Artificial Sequence
  Synthetic Construct
acgacagtaatgggagggaatga

SEQ ID NO: 42872 - DNA, 24 bp, Artificial Sequence
  Synthetic Construct
gggaatggctgatgttaagagaca

SEQ ID NO: 42873 - DNA, 20 bp, Artificial Sequence
  Synthetic Construct
ttgggagaagcaggcacaga

SEQ ID NO: 42874 - DNA, 20 bp, Artificial Sequence
  Synthetic Construct
acgctggagctggtgaaaca

SEQ ID NO: 42875 - DNA, 21 bp, Artificial Sequence
  Synthetic Construct
gtggcaaaattgccctcttgt

SEQ ID NO: 42876 - DNA, 22 bp, Artificial Sequence
  Synthetic Construct
ggaccacggatgatgcttttca

SEQ ID NO: 42877 - DNA, 25 bp, Artificial Sequence
  Synthetic Construct
accacataaaaccaggaaggaatgt

SEQ ID NO: 42878 - DNA, 22 bp, Artificial Sequence
  Synthetic Construct
gccctacaggagtggctttcat

SEQ ID NO: 42879 - DNA, 22 bp, Artificial Sequence
  Synthetic Construct
ggcacaaggagtcctggcttta

SEQ ID NO: 42880 - DNA, 22 bp, Artificial Sequence
  Synthetic Construct
ctctcatgcccaaactccactt

SEQ ID NO: 42881 - DNA, 20 bp, Artificial Sequence
  Synthetic Construct
cgacagcacaggctccagtt

SEQ ID NO: 42882 - DNA, 20 bp, Artificial Sequence
  Synthetic Construct
gcactgcggatcacttccat

SEQ ID NO: 42883 - DNA, 23 bp, Artificial Sequence
  Synthetic Construct
cctgtgttttgcagctcctccta

SEQ ID NO: 42884 - DNA, 24 bp, Artificial Sequence
  Synthetic Construct
ccctgcagataattctgcctgttg

SEQ ID NO: 42885 - DNA, 22 bp, Artificial Sequence
  Synthetic Construct
cagccaaacataaagccgtgtt

SEQ ID NO: 42886 - DNA, 20 bp, Artificial Sequence
  Synthetic Construct
tctttggccactgccctaca

SEQ ID NO: 42887 - DNA, 26 bp, Artificial Sequence
  Synthetic Construct
ctgtcctacctcaggggtatatcaac

SEQ ID NO: 42888 - DNA, 26 bp, Artificial Sequence
  Synthetic Construct
agacagtcttgaccactttctacttg

SEQ ID NO: 42889 - DNA, 20 bp, Artificial Sequence
  Synthetic Construct
tggtcccgtttgccgagaca

SEQ ID NO: 42890 - DNA, 20 bp, Artificial Sequence
  Synthetic Construct
ggcaaacagcctctctgaca

SEQ ID NO: 42891 - DNA, 25 bp, Artificial Sequence
  Synthetic Construct
agcttcttcccagatttgaatcact

SEQ ID NO: 42892 - DNA, 19 bp, Artificial Sequence
  Synthetic Construct
tgtcttgggcctcctgcaa

SEQ ID NO: 42893 - DNA, 24 bp, Artificial Sequence
  Synthetic Construct
tcctttgaaattagctggccttgt

SEQ ID NO: 42894 - DNA, 20 bp, Artificial Sequence
  Synthetic Construct
atggcaacagggaggcaaag

SEQ ID NO: 42895 - DNA, 22 bp, Artificial Sequence
  Synthetic Construct
ggcagatttctccagcttgtca

SEQ ID NO: 42896 - DNA, 22 bp, Artificial Sequence
  Synthetic Construct
gtggcagcagtagactcaccat

SEQ ID NO: 42897 - DNA, 24 bp, Artificial Sequence
  Synthetic Construct
ccctactctgaatcaagcggcaaa

SEQ ID NO: 42898 - DNA, 25 bp, Artificial Sequence
  Synthetic Construct
cagcagcccattttaacttccattg

SEQ ID NO: 42899 - DNA, 20 bp, Artificial Sequence
  Synthetic Construct
tcaggcaacctcccaccatt

SEQ ID NO: 42900 - DNA, 22 bp, Artificial Sequence
  Synthetic Construct
catcatcctccctgggcttgta

SEQ ID NO: 42901 - DNA, 22 bp, Artificial Sequence
  Synthetic Construct
ggtgttgggtggctgaaagaca

SEQ ID NO: 42902 - DNA, 20 bp, Artificial Sequence
  Synthetic Construct
ctttgtggcttggggagtga

SEQ ID NO: 42903 - DNA, 20 bp, Artificial Sequence
  Synthetic Construct
ggaaggcactggctgctaat

SEQ ID NO: 42904 - DNA, 21 bp, Artificial Sequence
  Synthetic Construct
tggaccactgctgccactact

SEQ ID NO: 42905 - DNA, 20 bp, Artificial Sequence
  Synthetic Construct
gcacttgctcgtctccttct

SEQ ID NO: 42906 - DNA, 21 bp, Artificial Sequence
  Synthetic Construct
ggtctcaggagcctggtggta

SEQ ID NO: 42907 - DNA, 19 bp, Artificial Sequence
  Synthetic Construct
agagggcaggcgggaatca

SEQ ID NO: 42908 - DNA, 19 bp, Artificial Sequence
  Synthetic Construct
tctgccttcagggccagta

SEQ ID NO: 42909 - DNA, 25 bp, Artificial Sequence
  Synthetic Construct
cctgcatagtggttaggagggtgta

SEQ ID NO: 42910 - DNA, 22 bp, Artificial Sequence
  Synthetic Construct
tggagatcctggctgtcacctt

SEQ ID NO: 42911 - DNA, 19 bp, Artificial Sequence
  Synthetic Construct
ccaccaggggtcagacact

SEQ ID NO: 42912 - DNA, 21 bp, Artificial Sequence
  Synthetic Construct
tggaaaaagggtctgcgtgaa

SEQ ID NO: 42913 - DNA, 25 bp, Artificial Sequence
  Synthetic Construct
ccctgacagacaaccgtcttccttt

SEQ ID NO: 42914 - DNA, 20 bp, Artificial Sequence
  Synthetic Construct
tctgctttcgctgcttcgtt

SEQ ID NO: 42915 - DNA, 20 bp, Artificial Sequence
  Synthetic Construct
tgctgtgctgcccctggtta

SEQ ID NO: 42916 - DNA, 22 bp, Artificial Sequence
  Synthetic Construct
gggtgatggatctgctgtgact

SEQ ID NO: 42917 - DNA, 21 bp, Artificial Sequence
  Synthetic Construct
tggctgaatgggcaggtggat

SEQ ID NO: 42918 - DNA, 22 bp, Artificial Sequence
  Synthetic Construct
gtccccactgcaccttacatca

SEQ ID NO: 42919 - DNA, 20 bp, Artificial Sequence
  Synthetic Construct
gctgccagaggagtgtgtga

SEQ ID NO: 42920 - DNA, 20 bp, Artificial Sequence
  Synthetic Construct
cacggcaaaggccagagttt

SEQ ID NO: 42921 - DNA, 23 bp, Artificial Sequence
  Synthetic Construct
ggtctgcatactgcagttacctt

SEQ ID NO: 42922 - DNA, 19 bp, Artificial Sequence
  Synthetic Construct
gctgacagcaggggctact

SEQ ID NO: 42923 - DNA, 23 bp, Artificial Sequence
  Synthetic Construct
ctctcagggagcttggtttttga

SEQ ID NO: 42924 - DNA, 19 bp, Artificial Sequence
  Synthetic Construct
aggccaaaggacgggtgaa

SEQ ID NO: 42925 - DNA, 23 bp, Artificial Sequence
  Synthetic Construct
gacctgaatagcacacacagact

SEQ ID NO: 42926 - DNA, 25 bp, Artificial Sequence
  Synthetic Construct
agtcttaaactaggtgacactgcaa

SEQ ID NO: 42927 - DNA, 24 bp, Artificial Sequence
  Synthetic Construct
tcaggctgatagaaaatcctgctt

SEQ ID NO: 42928 - DNA, 19 bp, Artificial Sequence
  Synthetic Construct
accaggtcggaggcgatga

SEQ ID NO: 42929 - DNA, 25 bp, Artificial Sequence
  Synthetic Construct
ccagaaaggggtttctcagggagtt

SEQ ID NO: 42930 - DNA, 22 bp, Artificial Sequence
  Synthetic Construct
ttccagctcaggtcagcacttg

SEQ ID NO: 42931 - DNA, 22 bp, Artificial Sequence
  Synthetic Construct
ctgacccagagggttgaacagt

SEQ ID NO: 42932 - DNA, 27 bp, Artificial Sequence
  Synthetic Construct
caactacttctaaccaccatcactact

SEQ ID NO: 42933 - DNA, 25 bp, Artificial Sequence
  Synthetic Construct
ccacacaacaaggattccagccata

SEQ ID NO: 42934 - DNA, 22 bp, Artificial Sequence
  Synthetic Construct
gtcccctattgctggacacctt

SEQ ID NO: 42935 - DNA, 21 bp, Artificial Sequence
  Synthetic Construct
aaggagtgggatggcgctaga

SEQ ID NO: 42936 - DNA, 20 bp, Artificial Sequence
  Synthetic Construct
tgccggaaaccaccaacctt

SEQ ID NO: 42937 - DNA, 26 bp, Artificial Sequence
  Synthetic Construct
ccatcatcaatcaccatgtcctgata

SEQ ID NO: 42938 - DNA, 20 bp, Artificial Sequence
  Synthetic Construct
tgtgcacttgccaggggttt

SEQ ID NO: 42939 - DNA, 21 bp, Artificial Sequence
  Synthetic Construct
gcaaaggcagctggcaatttt

SEQ ID NO: 42940 - DNA, 20 bp, Artificial Sequence
  Synthetic Construct
tgctacagggcagccaacat

SEQ ID NO: 42941 - DNA, 19 bp, Artificial Sequence
  Synthetic Construct
gactgtgccggttgagaca

SEQ ID NO: 42942 - DNA, 22 bp, Artificial Sequence
  Synthetic Construct
tgctcccctccctcaaatggat

SEQ ID NO: 42943 - DNA, 22 bp, Artificial Sequence
  Synthetic Construct
tgggaggggcatatgggacaat

SEQ ID NO: 42944 - DNA, 22 bp, Artificial Sequence
  Synthetic Construct
ccatctgatcccagcctgcttt

SEQ ID NO: 42945 - DNA, 22 bp, Artificial Sequence
  Synthetic Construct
cccgacaacagtggagcagaaa

SEQ ID NO: 42946 - DNA, 18 bp, Artificial Sequence
  Synthetic Construct
tggtttggggcgcattga

SEQ ID NO: 42947 - DNA, 23 bp, Artificial Sequence
  Synthetic Construct
atgcagagggagttgcaataaga

SEQ ID NO: 42948 - DNA, 22 bp, Artificial Sequence
  Synthetic Construct
ctgtccagaacccattccatga

SEQ ID NO: 42949 - DNA, 24 bp, Artificial Sequence
  Synthetic Construct
tggatgactgttgtaacccacttg

SEQ ID NO: 42950 - DNA, 22 bp, Artificial Sequence
  Synthetic Construct
tcctggggtccagaggtaactt

SEQ ID NO: 42951 - DNA, 24 bp, Artificial Sequence
  Synthetic Construct
aggtagccttccaaagtgagaaaa

SEQ ID NO: 42952 - DNA, 23 bp, Artificial Sequence
  Synthetic Construct
aggactcagttacctggtgtttg

SEQ ID NO: 42953 - DNA, 20 bp, Artificial Sequence
  Synthetic Construct
cattggcccatggactgaca

SEQ ID NO: 42954 - DNA, 19 bp, Artificial Sequence
  Synthetic Construct
cccaggctcgtacgggtaa

SEQ ID NO: 42955 - DNA, 20 bp, Artificial Sequence
  Synthetic Construct
gcacatgctgggtggctttg

SEQ ID NO: 42956 - DNA, 22 bp, Artificial Sequence
  Synthetic Construct
gggaggatggcattcacagcaa

SEQ ID NO: 42957 - DNA, 20 bp, Artificial Sequence
  Synthetic Construct
tgaggccaacagtgccagaa

SEQ ID NO: 42958 - DNA, 23 bp, Artificial Sequence
  Synthetic Construct
gtcacgcaagagactgttaggtt

SEQ ID NO: 42959 - DNA, 24 bp, Artificial Sequence
  Synthetic Construct
ggggagctaaaaggcacatgtttg

SEQ ID NO: 42960 - DNA, 21 bp, Artificial Sequence
  Synthetic Construct
acagcccctaccagggtttac

SEQ ID NO: 42961 - DNA, 19 bp, Artificial Sequence
  Synthetic Construct
cagtggaccgactgctgtt

SEQ ID NO: 42962 - DNA, 24 bp, Artificial Sequence
  Synthetic Construct
gctctaatcctctgtggctgaaca

SEQ ID NO: 42963 - DNA, 25 bp, Artificial Sequence
  Synthetic Construct
gcttgaatcaatgggcatctctgaa

SEQ ID NO: 42964 - DNA, 24 bp, Artificial Sequence
  Synthetic Construct
cattgtctgcacaggtaaaccaat

SEQ ID NO: 42965 - DNA, 21 bp, Artificial Sequence
  Synthetic Construct
agacccagccacatgtctact

SEQ ID NO: 42966 - DNA, 21 bp, Artificial Sequence
  Synthetic Construct
ttggttgcaggaggggaccaa

SEQ ID NO: 42967 - DNA, 24 bp, Artificial Sequence
  Synthetic Construct
gcgagcttagagcagagaggaact

SEQ ID NO: 42968 - DNA, 22 bp, Artificial Sequence
  Synthetic Construct
agactgggagagaaagcaggaa

SEQ ID NO: 42969 - DNA, 26 bp, Artificial Sequence
  Synthetic Construct
gcaaagcagactacactcactgtcat

SEQ ID NO: 42970 - DNA, 20 bp, Artificial Sequence
  Synthetic Construct
ccacatgctccacactgctt

SEQ ID NO: 42971 - DNA, 22 bp, Artificial Sequence
  Synthetic Construct
cctttcacctcagcccaaccta

SEQ ID NO: 42972 - DNA, 26 bp, Artificial Sequence
  Synthetic Construct
cctgcaccataccactgtcctcatag

SEQ ID NO: 42973 - DNA, 28 bp, Artificial Sequence
  Synthetic Construct
ggaccagctataacttgatggactgaac

SEQ ID NO: 42974 - DNA, 23 bp, Artificial Sequence
  Synthetic Construct
gcagtatgtcttcgctggtcaac

SEQ ID NO: 42975 - DNA, 22 bp, Artificial Sequence
  Synthetic Construct
aagcaaggtggaagcttctgat

SEQ ID NO: 42976 - DNA, 23 bp, Artificial Sequence
  Synthetic Construct
gaatttctcacgtctgcctgtct

SEQ ID NO: 42977 - DNA, 20 bp, Artificial Sequence
  Synthetic Construct
aaagcacctgcggtctgtct

SEQ ID NO: 42978 - DNA, 23 bp, Artificial Sequence
  Synthetic Construct
ggctcacctgtgagtaagtgtct

SEQ ID NO: 42979 - DNA, 20 bp, Artificial Sequence
  Synthetic Construct
tgcgccaactggggtaccat

SEQ ID NO: 42980 - DNA, 22 bp, Artificial Sequence
  Synthetic Construct
ggcgaccaagccttgcttatga

SEQ ID NO: 42981 - DNA, 20 bp, Artificial Sequence
  Synthetic Construct
atgcggcagggacccgattc

SEQ ID NO: 42982 - DNA, 19 bp, Artificial Sequence
  Synthetic Construct
ccctgagtggtgcctccat

SEQ ID NO: 42983 - DNA, 26 bp, Artificial Sequence
  Synthetic Construct
cactcccatcctacttgaaacaaatc

SEQ ID NO: 42984 - DNA, 24 bp, Artificial Sequence
  Synthetic Construct
ggcagagaacagagaactgtggat

SEQ ID NO: 42985 - DNA, 26 bp, Artificial Sequence
  Synthetic Construct
gggcaggtaggtaaaaggatcagtct

SEQ ID NO: 42986 - DNA, 23 bp, Artificial Sequence
  Synthetic Construct
tgctctgaatgaaacccaactct

SEQ ID NO: 42987 - DNA, 26 bp, Artificial Sequence
  Synthetic Construct
caaggtacactttctcccataagaca

SEQ ID NO: 42988 - DNA, 25 bp, Artificial Sequence
  Synthetic Construct
tgagtctaatttagcgtggggtaac

SEQ ID NO: 42989 - DNA, 22 bp, Artificial Sequence
  Synthetic Construct
aggaagccgaccaaaggcaatc

SEQ ID NO: 42990 - DNA, 21 bp, Artificial Sequence
  Synthetic Construct
ccccgagaggagcagagttta

SEQ ID NO: 42991 - DNA, 24 bp, Artificial Sequence
  Synthetic Construct
actcaaccactgccataattgcta

SEQ ID NO: 42992 - DNA, 24 bp, Artificial Sequence
  Synthetic Construct
ctgatccagagtaggtgcacaatc

SEQ ID NO: 42993 - DNA, 20 bp, Artificial Sequence
  Synthetic Construct
agggtggcctcctgtgtcta

SEQ ID NO: 42994 - DNA, 23 bp, Artificial Sequence
  Synthetic Construct
gacaacagggaaccctcatctca

SEQ ID NO: 42995 - DNA, 22 bp, Artificial Sequence
  Synthetic Construct
ggcttgccagagaaggaaggat

SEQ ID NO: 42996 - DNA, 27 bp, Artificial Sequence
  Synthetic Construct
ctggtttcaaatgttccaaggcctatt

SEQ ID NO: 42997 - DNA, 20 bp, Artificial Sequence
  Synthetic Construct
acccgccctctcttcctttg

SEQ ID NO: 42998 - DNA, 22 bp, Artificial Sequence
  Synthetic Construct
ggctctgtgggatgacagcata

SEQ ID NO: 42999 - DNA, 20 bp, Artificial Sequence
  Synthetic Construct
ttggctgtcaccacccattg

SEQ ID NO: 43000 - DNA, 22 bp, Artificial Sequence
  Synthetic Construct
gctcagcattccaccccattct

SEQ ID NO: 43001 - DNA, 26 bp, Artificial Sequence
  Synthetic Construct
ccaagactcctgcttattttctccaa

SEQ ID NO: 43002 - DNA, 25 bp, Artificial Sequence
  Synthetic Construct
cactagtggacacctaagtcagctt

SEQ ID NO: 43003 - DNA, 21 bp, Artificial Sequence
  Synthetic Construct
cccgtgcacatgtgttgtttg

SEQ ID NO: 43004 - DNA, 21 bp, Artificial Sequence
  Synthetic Construct
cgttcaccacacatgccaatg

SEQ ID NO: 43005 - DNA, 20 bp, Artificial Sequence
  Synthetic Construct
ccagtggctgaactgtgcat

SEQ ID NO: 43006 - DNA, 24 bp, Artificial Sequence
  Synthetic Construct
gggagtttacgtgtcttgtgtttg

SEQ ID NO: 43007 - DNA, 22 bp, Artificial Sequence
  Synthetic Construct
ctgctcatcaagcactcgacaa

SEQ ID NO: 43008 - DNA, 20 bp, Artificial Sequence
  Synthetic Construct
gcctgaaatgcagccaccat

SEQ ID NO: 43009 - DNA, 23 bp, Artificial Sequence
  Synthetic Construct
ttctgtcagcttggctgatgtta

SEQ ID NO: 43010 - DNA, 26 bp, Artificial Sequence
  Synthetic Construct
ctggttcttaggtttagttcctggat

SEQ ID NO: 43011 - DNA, 24 bp, Artificial Sequence
  Synthetic Construct
cacgaagcaaagactagcatctca

SEQ ID NO: 43012 - DNA, 30 bp, Artificial Sequence
  Synthetic Construct
ccacgttaaaactagagaagacatgggtta

SEQ ID NO: 43013 - DNA, 22 bp, Artificial Sequence
  Synthetic Construct
gctcctgtcttgcagtttctct

SEQ ID NO: 43014 - DNA, 22 bp, Artificial Sequence
  Synthetic Construct
cctgggcttcctcccacaattt

SEQ ID NO: 43015 - DNA, 25 bp, Artificial Sequence
  Synthetic Construct
ggtgctaaatttttcccgtcacaag

SEQ ID NO: 43016 - DNA, 21 bp, Artificial Sequence
  Synthetic Construct
tgttccccatcccacatgaag

SEQ ID NO: 43017 - DNA, 27 bp, Artificial Sequence
  Synthetic Construct
ccaaagtcaaaagggtgagaaggagtt

SEQ ID NO: 43018 - DNA, 21 bp, Artificial Sequence
  Synthetic Construct
tgtctgtccacttcccacact

SEQ ID NO: 43019 - DNA, 21 bp, Artificial Sequence
  Synthetic Construct
gatctgcacgtccacctacat

SEQ ID NO: 43020 - DNA, 22 bp, Artificial Sequence
  Synthetic Construct
gctgcagccagaggttttcaga

SEQ ID NO: 43021 - DNA, 24 bp, Artificial Sequence
  Synthetic Construct
cctcaagcatgactccaaagttga

SEQ ID NO: 43022 - DNA, 28 bp, Artificial Sequence
  Synthetic Construct
cttctagagtgtggagaatctaggtaca

SEQ ID NO: 43023 - DNA, 19 bp, Artificial Sequence
  Synthetic Construct
ctggcaggcctgactttgt

SEQ ID NO: 43024 - DNA, 25 bp, Artificial Sequence
  Synthetic Construct
cctggttctcagtctgtggctttag

SEQ ID NO: 43025 - DNA, 22 bp, Artificial Sequence
  Synthetic Construct
aggaaggggatgaggaagagtt

SEQ ID NO: 43026 - DNA, 24 bp, Artificial Sequence
  Synthetic Construct
cctcaaagggtaatcccagcatga

SEQ ID NO: 43027 - DNA, 23 bp, Artificial Sequence
  Synthetic Construct
ttaaaactggacagccactcctt

SEQ ID NO: 43028 - DNA, 20 bp, Artificial Sequence
  Synthetic Construct
cccatgggtgggtcatgtct

SEQ ID NO: 43029 - DNA, 22 bp, Artificial Sequence
  Synthetic Construct
ggttcctttccaggagtgtcaa

SEQ ID NO: 43030 - DNA, 25 bp, Artificial Sequence
  Synthetic Construct
gctcttgaaactcctctccctcatt

SEQ ID NO: 43031 - DNA, 22 bp, Artificial Sequence
  Synthetic Construct
ggcagtgaacgcatgtccctaa

SEQ ID NO: 43032 - DNA, 21 bp, Artificial Sequence
  Synthetic Construct
acctctctgcacagccagcat

SEQ ID NO: 43033 - DNA, 26 bp, Artificial Sequence
  Synthetic Construct
cacacttgaattcgttgcctacagtt

SEQ ID NO: 43034 - DNA, 25 bp, Artificial Sequence
  Synthetic Construct
ccatagaagtccgagaatgtcactt

SEQ ID NO: 43035 - DNA, 25 bp, Artificial Sequence
  Synthetic Construct
cccaaatagctcaagccaagtctgt

SEQ ID NO: 43036 - DNA, 22 bp, Artificial Sequence
  Synthetic Construct
ccatcttggctgcccgattctt

SEQ ID NO: 43037 - DNA, 19 bp, Artificial Sequence
  Synthetic Construct
aggcaccggaagccttaac

SEQ ID NO: 43038 - DNA, 24 bp, Artificial Sequence
  Synthetic Construct
cccatgagcttaacagccctggaa

SEQ ID NO: 43039 - DNA, 22 bp, Artificial Sequence
  Synthetic Construct
ggttttagccgaagcccacaac

SEQ ID NO: 43040 - DNA, 26 bp, Artificial Sequence
  Synthetic Construct
gaccagaagctgtatttaccccagat

SEQ ID NO: 43041 - DNA, 21 bp, Artificial Sequence
  Synthetic Construct
atggagggcagggctggagtt

SEQ ID NO: 43042 - DNA, 26 bp, Artificial Sequence
  Synthetic Construct
cttctagcattcccactatcagaaca

SEQ ID NO: 43043 - DNA, 20 bp, Artificial Sequence
  Synthetic Construct
ctgtggagcttgtggagctt

SEQ ID NO: 43044 - DNA, 24 bp, Artificial Sequence
  Synthetic Construct
gcctaagcaggttcctaccccata

SEQ ID NO: 43045 - DNA, 25 bp, Artificial Sequence
  Synthetic Construct
gtcctagccttactgaatggtgaac

SEQ ID NO: 43046 - DNA, 29 bp, Artificial Sequence
  Synthetic Construct
gagtcatagaattttcagccttcgacatc

SEQ ID NO: 43047 - DNA, 22 bp, Artificial Sequence
  Synthetic Construct
tgcctaggaaagggctcacaga

SEQ ID NO: 43048 - DNA, 25 bp, Artificial Sequence
  Synthetic Construct
aacagaagagggctatttccattgt

SEQ ID NO: 43049 - DNA, 27 bp, Artificial Sequence
  Synthetic Construct
ggagcttaacatcttggtatggtcaag

SEQ ID NO: 43050 - DNA, 24 bp, Artificial Sequence
  Synthetic Construct
gcattgttcaaggctgagactcta

SEQ ID NO: 43051 - DNA, 26 bp, Artificial Sequence
  Synthetic Construct
gcagtaatttgcatcgaaagggatgt

SEQ ID NO: 43052 - DNA, 22 bp, Artificial Sequence
  Synthetic Construct
agcagcctccccagaggtaata

SEQ ID NO: 43053 - DNA, 25 bp, Artificial Sequence
  Synthetic Construct
cgcatatgcatcaaaaccacacaca

SEQ ID NO: 43054 - DNA, 24 bp, Artificial Sequence
  Synthetic Construct
gtctgacagttgccaaagaccaaa

SEQ ID NO: 43055 - DNA, 24 bp, Artificial Sequence
  Synthetic Construct
ccgaccagctaagctcatctcaag

SEQ ID NO: 43056 - DNA, 22 bp, Artificial Sequence
  Synthetic Construct
ttggaaccactcctttcacaca

SEQ ID NO: 43057 - DNA, 25 bp, Artificial Sequence
  Synthetic Construct
acctattgcttcattccacgttaga

SEQ ID NO: 43058 - DNA, 24 bp, Artificial Sequence
  Synthetic Construct
atcagtatgacatccctgccaaat

SEQ ID NO: 43059 - DNA, 26 bp, Artificial Sequence
  Synthetic Construct
gacctaacatgcagtttggagtcaag

SEQ ID NO: 43060 - DNA, 24 bp, Artificial Sequence
  Synthetic Construct
cagcagtgtttttgagaggcattg

SEQ ID NO: 43061 - DNA, 24 bp, Artificial Sequence
  Synthetic Construct
gccagaaaaggaagatcctagcaa

SEQ ID NO: 43062 - DNA, 25 bp, Artificial Sequence
  Synthetic Construct
gatcacagtttgttccttgccatag

SEQ ID NO: 43063 - DNA, 23 bp, Artificial Sequence
  Synthetic Construct
tgtctatccaccacaacctgagt

SEQ ID NO: 43064 - DNA, 20 bp, Artificial Sequence
  Synthetic Construct
gcctctgtcccatgctcatc

SEQ ID NO: 43065 - DNA, 25 bp, Artificial Sequence
  Synthetic Construct
accctcctcaacagaagtaactgaa

SEQ ID NO: 43066 - DNA, 20 bp, Artificial Sequence
  Synthetic Construct
ccacacaggcatgtcccaaa

SEQ ID NO: 43067 - DNA, 21 bp, Artificial Sequence
  Synthetic Construct
aggaactgtgctgcattccat

SEQ ID NO: 43068 - DNA, 22 bp, Artificial Sequence
  Synthetic Construct
agcctacaaggggagcagagat

SEQ ID NO: 43069 - DNA, 19 bp, Artificial Sequence
  Synthetic Construct
agacagtgggctgccgtta

SEQ ID NO: 43070 - DNA, 22 bp, Artificial Sequence
  Synthetic Construct
gcctgaacccagacagatcaca

SEQ ID NO: 43071 - DNA, 27 bp, Artificial Sequence
  Synthetic Construct
ctcttttcttgacacttgccttacaac

SEQ ID NO: 43072 - DNA, 22 bp, Artificial Sequence
  Synthetic Construct
tgagtggtgccacttccacttc

SEQ ID NO: 43073 - DNA, 23 bp, Artificial Sequence
  Synthetic Construct
ccatctgagacatgttgccagta

SEQ ID NO: 43074 - DNA, 28 bp, Artificial Sequence
  Synthetic Construct
gactgtttaattggcccatagcttccta

SEQ ID NO: 43075 - DNA, 25 bp, Artificial Sequence
  Synthetic Construct
cccaataggactttccaaacctgta

SEQ ID NO: 43076 - DNA, 23 bp, Artificial Sequence
  Synthetic Construct
actttgagccattgtgtggaaga

SEQ ID NO: 43077 - DNA, 20 bp, Artificial Sequence
  Synthetic Construct
ggaggcaaagccaggattca

SEQ ID NO: 43078 - DNA, 18 bp, Artificial Sequence
  Synthetic Construct
tgggactcctgcggtgtt

SEQ ID NO: 43079 - DNA, 22 bp, Artificial Sequence
  Synthetic Construct
ctcacactgtaccctcctggtt

SEQ ID NO: 43080 - DNA, 29 bp, Artificial Sequence
  Synthetic Construct
cctggactcaaaagctaaggaggattcta

SEQ ID NO: 43081 - DNA, 24 bp, Artificial Sequence
  Synthetic Construct
atgatggcctcggtattaaacagt

SEQ ID NO: 43082 - DNA, 20 bp, Artificial Sequence
  Synthetic Construct
ggccaaattgccaggagctt

SEQ ID NO: 43083 - DNA, 26 bp, Artificial Sequence
  Synthetic Construct
ggagaatttatgacttgggagaccat

SEQ ID NO: 43084 - DNA, 25 bp, Artificial Sequence
  Synthetic Construct
tctgttgcaagcatttaaggggtat

SEQ ID NO: 43085 - DNA, 22 bp, Artificial Sequence
  Synthetic Construct
ccgtccaaagggcagtttgtgt

SEQ ID NO: 43086 - DNA, 20 bp, Artificial Sequence
  Synthetic Construct
gccttctgcaagctgtggtt

SEQ ID NO: 43087 - DNA, 24 bp, Artificial Sequence
  Synthetic Construct
gggaagttcagattccagccacaa

SEQ ID NO: 43088 - DNA, 24 bp, Artificial Sequence
  Synthetic Construct
ggcctccatgcagatattgggaaa

SEQ ID NO: 43089 - DNA, 22 bp, Artificial Sequence
  Synthetic Construct
tgctccattggcaggaggtaac

SEQ ID NO: 43090 - DNA, 25 bp, Artificial Sequence
  Synthetic Construct
gctgttaagtggtagggctgagcat

SEQ ID NO: 43091 - DNA, 28 bp, Artificial Sequence
  Synthetic Construct
ggatagagtatgggaatgaaagggtaag

SEQ ID NO: 43092 - DNA, 22 bp, Artificial Sequence
  Synthetic Construct
ggctagcccaggcttgttctta

SEQ ID NO: 43093 - DNA, 25 bp, Artificial Sequence
  Synthetic Construct
agagaaatcaaggtttggtggaaga

SEQ ID NO: 43094 - DNA, 25 bp, Artificial Sequence
  Synthetic Construct
cagtggtgtttgtaaggtaggcaat

SEQ ID NO: 43095 - DNA, 25 bp, Artificial Sequence
  Synthetic Construct
tgtttaagagctgtggactctttca

SEQ ID NO: 43096 - DNA, 26 bp, Artificial Sequence
  Synthetic Construct
cagtaatcctgattcaagaggggaaa

SEQ ID NO: 43097 - DNA, 22 bp, Artificial Sequence
  Synthetic Construct
ccaccttgaggctccaagtaac

SEQ ID NO: 43098 - DNA, 23 bp, Artificial Sequence
  Synthetic Construct
aaaacaactgcagctctgtcatc

SEQ ID NO: 43099 - DNA, 21 bp, Artificial Sequence
  Synthetic Construct
tccagggcttctctgccaaca

SEQ ID NO: 43100 - DNA, 24 bp, Artificial Sequence
  Synthetic Construct
aggattctggggtaaaaggaggtt

SEQ ID NO: 43101 - DNA, 20 bp, Artificial Sequence
  Synthetic Construct
ggatgcaggcccttctctct

SEQ ID NO: 43102 - DNA, 21 bp, Artificial Sequence
  Synthetic Construct
gccaacggctaagctaacgat

SEQ ID NO: 43103 - DNA, 23 bp, Artificial Sequence
  Synthetic Construct
acagtaaacggctcccatttgtt

SEQ ID NO: 43104 - DNA, 20 bp, Artificial Sequence
  Synthetic Construct
tgcctctccgcttagccaat

SEQ ID NO: 43105 - DNA, 23 bp, Artificial Sequence
  Synthetic Construct
ggtaggatgaacacaggtcagtt

SEQ ID NO: 43106 - DNA, 25 bp, Artificial Sequence
  Synthetic Construct
gatcttacatgtcccagtgttctgt

SEQ ID NO: 43107 - DNA, 22 bp, Artificial Sequence
  Synthetic Construct
gatccatcccaacaagctcaga

SEQ ID NO: 43108 - DNA, 20 bp, Artificial Sequence
  Synthetic Construct
tgtccacccacagctcagat

SEQ ID NO: 43109 - DNA, 21 bp, Artificial Sequence
  Synthetic Construct
agccagaggtccctcagcaat

SEQ ID NO: 43110 - DNA, 20 bp, Artificial Sequence
  Synthetic Construct
agttggcctctggagcacat

SEQ ID NO: 43111 - DNA, 23 bp, Artificial Sequence
  Synthetic Construct
gcttaatgacggtgggtcctaca

SEQ ID NO: 43112 - DNA, 21 bp, Artificial Sequence
  Synthetic Construct
ggatgtgttgccccaatctgt

SEQ ID NO: 43113 - DNA, 25 bp, Artificial Sequence
  Synthetic Construct
gggcagaaaatgtcctcaggcataa

SEQ ID NO: 43114 - DNA, 25 bp, Artificial Sequence
  Synthetic Construct
gccctcaccttttcatccaagagtt

SEQ ID NO: 43115 - DNA, 24 bp, Artificial Sequence
  Synthetic Construct
cctgctccttttccacctttctac

SEQ ID NO: 43116 - DNA, 20 bp, Artificial Sequence
  Synthetic Construct
aaggctgacagtccctcact

SEQ ID NO: 43117 - DNA, 23 bp, Artificial Sequence
  Synthetic Construct
tgattgctgcctcaggatacttt

SEQ ID NO: 43118 - DNA, 22 bp, Artificial Sequence
  Synthetic Construct
agagtgacgaacccaggcatag

SEQ ID NO: 43119 - DNA, 24 bp, Artificial Sequence
  Synthetic Construct
cccatcctgtttgtagctggaatg

SEQ ID NO: 43120 - DNA, 19 bp, Artificial Sequence
  Synthetic Construct
tgcactggcccgtgacgaa

SEQ ID NO: 43121 - DNA, 21 bp, Artificial Sequence
  Synthetic Construct
agtctgggcagcagacagtga

SEQ ID NO: 43122 - DNA, 22 bp, Artificial Sequence
  Synthetic Construct
tgctcaacttccctccctgact

SEQ ID NO: 43123 - DNA, 24 bp, Artificial Sequence
  Synthetic Construct
gctgcattttggggtcctcctatt

SEQ ID NO: 43124 - DNA, 20 bp, Artificial Sequence
  Synthetic Construct
ttcccctacagcagctccaa

SEQ ID NO: 43125 - DNA, 26 bp, Artificial Sequence
  Synthetic Construct
gccttcatgcctgaacctatcctact

SEQ ID NO: 43126 - DNA, 26 bp, Artificial Sequence
  Synthetic Construct
gggtttccacatagaaacaaggagaa

SEQ ID NO: 43127 - DNA, 20 bp, Artificial Sequence
  Synthetic Construct
cctgctgttgttcccaggtt

SEQ ID NO: 43128 - DNA, 23 bp, Artificial Sequence
  Synthetic Construct
aggtccctggagttccctctttc

SEQ ID NO: 43129 - DNA, 27 bp, Artificial Sequence
  Synthetic Construct
gtgtgatacttccaggtaatgtgtgaa

SEQ ID NO: 43130 - DNA, 25 bp, Artificial Sequence
  Synthetic Construct
ccttcctcaattggctgatggctaa

SEQ ID NO: 43131 - DNA, 23 bp, Artificial Sequence
  Synthetic Construct
gccccaatttctcctccttccat

SEQ ID NO: 43132 - DNA, 23 bp, Artificial Sequence
  Synthetic Construct
ggctaacatctgacactggcttt

SEQ ID NO: 43133 - DNA, 20 bp, Artificial Sequence
  Synthetic Construct
tggctgcatgattcccagtt

SEQ ID NO: 43134 - DNA, 25 bp, Artificial Sequence
  Synthetic Construct
atatctactgtgtgctgtgaactgt

SEQ ID NO: 43135 - DNA, 23 bp, Artificial Sequence
  Synthetic Construct
acagtaggcattgggaaacttga

SEQ ID NO: 43136 - DNA, 20 bp, Artificial Sequence
  Synthetic Construct
accgaaaaggctgtgtgtgt

SEQ ID NO: 43137 - DNA, 23 bp, Artificial Sequence
  Synthetic Construct
acaaaggtaaaaggtggcagaga

SEQ ID NO: 43138 - DNA, 22 bp, Artificial Sequence
  Synthetic Construct
agttgtttacccagcacacact

SEQ ID NO: 43139 - DNA, 24 bp, Artificial Sequence
  Synthetic Construct
gtgggaatggagctcctgtacttg

SEQ ID NO: 43140 - DNA, 23 bp, Artificial Sequence
  Synthetic Construct
gctggaacctgtttccccttatg

SEQ ID NO: 43141 - DNA, 23 bp, Artificial Sequence
  Synthetic Construct
ctttctactgctgccttgctttc

SEQ ID NO: 43142 - DNA, 24 bp, Artificial Sequence
  Synthetic Construct
gggtgagggtacactccagtaaaa

SEQ ID NO: 43143 - DNA, 20 bp, Artificial Sequence
  Synthetic Construct
ggcatggcccttttccttgt

SEQ ID NO: 43144 - DNA, 22 bp, Artificial Sequence
  Synthetic Construct
accaggacgtcaccacagaaac

SEQ ID NO: 43145 - DNA, 25 bp, Artificial Sequence
  Synthetic Construct
ggctagtaactaactgccctgaatc

SEQ ID NO: 43146 - DNA, 24 bp, Artificial Sequence
  Synthetic Construct
gcctcactctgccttatggtgcat

SEQ ID NO: 43147 - DNA, 25 bp, Artificial Sequence
  Synthetic Construct
acagctgttttatcctgaggctatt

SEQ ID NO: 43148 - DNA, 25 bp, Artificial Sequence
  Synthetic Construct
ctctctggtagttgctgttggtttc

SEQ ID NO: 43149 - DNA, 28 bp, Artificial Sequence
  Synthetic Construct
ggtggggagagaagagatgctatttttg

SEQ ID NO: 43150 - DNA, 29 bp, Artificial Sequence
  Synthetic Construct
ggtctataacctctgtgaaagccatcctt

SEQ ID NO: 43151 - DNA, 24 bp, Artificial Sequence
  Synthetic Construct
tttactctgaggaacagcaaggtt

SEQ ID NO: 43152 - DNA, 21 bp, Artificial Sequence
  Synthetic Construct
gtgcagccagaagtgacaaac

SEQ ID NO: 43153 - DNA, 22 bp, Artificial Sequence
  Synthetic Construct
ccgagtgtgctgttctcacaga

SEQ ID NO: 43154 - DNA, 20 bp, Artificial Sequence
  Synthetic Construct
ttctccctgcccttcctgtt

SEQ ID NO: 43155 - DNA, 22 bp, Artificial Sequence
  Synthetic Construct
agagacctttgcagcccaatag

SEQ ID NO: 43156 - DNA, 24 bp, Artificial Sequence
  Synthetic Construct
gcagctgtcattttgctggagtag

SEQ ID NO: 43157 - DNA, 20 bp, Artificial Sequence
  Synthetic Construct
tgcctagagccgcctttaac

SEQ ID NO: 43158 - DNA, 19 bp, Artificial Sequence
  Synthetic Construct
tggtgggtgcccactttct

SEQ ID NO: 43159 - DNA, 25 bp, Artificial Sequence
  Synthetic Construct
agtgagaatgtgttttggctgtact

SEQ ID NO: 43160 - DNA, 23 bp, Artificial Sequence
  Synthetic Construct
ctctgtcctcacaaaaccagtgt

SEQ ID NO: 43161 - DNA, 25 bp, Artificial Sequence
  Synthetic Construct
gtgtctttccttgttgctcttccaa

SEQ ID NO: 43162 - DNA, 26 bp, Artificial Sequence
  Synthetic Construct
cacagtcacagtttgtagggactatc

SEQ ID NO: 43163 - DNA, 27 bp, Artificial Sequence
  Synthetic Construct
gcaaaatcgatgtgaattctggacttg

SEQ ID NO: 43164 - DNA, 29 bp, Artificial Sequence
  Synthetic Construct
ccaccacctgttttgtaagaaaagcttca

SEQ ID NO: 43165 - DNA, 20 bp, Artificial Sequence
  Synthetic Construct
actgcagcactcggctcatt

SEQ ID NO: 43166 - DNA, 25 bp, Artificial Sequence
  Synthetic Construct
gaggaatgaacagtttaggggaact

SEQ ID NO: 43167 - DNA, 24 bp, Artificial Sequence
  Synthetic Construct
acaggtctctccctgcctctaatc

SEQ ID NO: 43168 - DNA, 23 bp, Artificial Sequence
  Synthetic Construct
caagctctttgtccacctgtttc

SEQ ID NO: 43169 - DNA, 21 bp, Artificial Sequence
  Synthetic Construct
tgtgctcctctggaggcaatc

SEQ ID NO: 43170 - DNA, 25 bp, Artificial Sequence
  Synthetic Construct
gcctgcctctaacatcaccctctta

SEQ ID NO: 43171 - DNA, 22 bp, Artificial Sequence
  Synthetic Construct
gacgcagagccagagtgtaaag

SEQ ID NO: 43172 - DNA, 26 bp, Artificial Sequence
  Synthetic Construct
cccatgtttttgagcaggagggattg

SEQ ID NO: 43173 - DNA, 21 bp, Artificial Sequence
  Synthetic Construct
tccggactcctctgctccaat

SEQ ID NO: 43174 - DNA, 23 bp, Artificial Sequence
  Synthetic Construct
gagttatgattgcaggccacgtt

SEQ ID NO: 43175 - DNA, 24 bp, Artificial Sequence
  Synthetic Construct
aactgtcacaggaaggaacagaaa

SEQ ID NO: 43176 - DNA, 24 bp, Artificial Sequence
  Synthetic Construct
gtcagagcctaacagcctttgata

SEQ ID NO: 43177 - DNA, 22 bp, Artificial Sequence
  Synthetic Construct
acaatgtggtgaggtgtgttga

SEQ ID NO: 43178 - DNA, 22 bp, Artificial Sequence
  Synthetic Construct
cggacatagctgtggtgcagat

SEQ ID NO: 43179 - DNA, 22 bp, Artificial Sequence
  Synthetic Construct
tcacaagcaggtgtccaaggaa

SEQ ID NO: 43180 - DNA, 22 bp, Artificial Sequence
  Synthetic Construct
gcagggacatatgttgcaggta

SEQ ID NO: 43181 - DNA, 21 bp, Artificial Sequence
  Synthetic Construct
gacgctgacgttactgctaga

SEQ ID NO: 43182 - DNA, 27 bp, Artificial Sequence
  Synthetic Construct
cccaacgacatatgttggagtggattc

SEQ ID NO: 43183 - DNA, 27 bp, Artificial Sequence
  Synthetic Construct
gtctggtaggacaaaagatccttcaac

SEQ ID NO: 43184 - DNA, 23 bp, Artificial Sequence
  Synthetic Construct
gagacctggcttctagccaaaga

SEQ ID NO: 43185 - DNA, 25 bp, Artificial Sequence
  Synthetic Construct
gggcctttttaaggtcctgggcata

SEQ ID NO: 43186 - DNA, 23 bp, Artificial Sequence
  Synthetic Construct
gtggcttcctgaacacgtacact

SEQ ID NO: 43187 - DNA, 25 bp, Artificial Sequence
  Synthetic Construct
gtcagtaaatgaagtgcctgctgat

SEQ ID NO: 43188 - DNA, 20 bp, Artificial Sequence
  Synthetic Construct
acagagcaggcagtgcatca

SEQ ID NO: 43189 - DNA, 21 bp, Artificial Sequence
  Synthetic Construct
cagagaaggaccagggagcat

SEQ ID NO: 43190 - DNA, 21 bp, Artificial Sequence
  Synthetic Construct
agccagtgctagctgggaaca

SEQ ID NO: 43191 - DNA, 21 bp, Artificial Sequence
  Synthetic Construct
tgagcctggacagctgtggta

SEQ ID NO: 43192 - DNA, 22 bp, Artificial Sequence
  Synthetic Construct
aacaaggaagccagttggagtt

SEQ ID NO: 43193 - DNA, 27 bp, Artificial Sequence
  Synthetic Construct
agcgggataataaactaagctcagaag

SEQ ID NO: 43194 - DNA, 26 bp, Artificial Sequence
  Synthetic Construct
cctggaagcttctgaaacagtaggaa

SEQ ID NO: 43195 - DNA, 26 bp, Artificial Sequence
  Synthetic Construct
agctttaaggactcaagaaggacaag

SEQ ID NO: 43196 - DNA, 24 bp, Artificial Sequence
  Synthetic Construct
ggaaaacatgacggggaaggatag

SEQ ID NO: 43197 - DNA, 20 bp, Artificial Sequence
  Synthetic Construct
tgctgggagctgtgtgtgta

SEQ ID NO: 43198 - DNA, 25 bp, Artificial Sequence
  Synthetic Construct
gttgtcagtgagaaatggctaccaa

SEQ ID NO: 43199 - DNA, 24 bp, Artificial Sequence
  Synthetic Construct
tgttttacatcagggcagaacgat

SEQ ID NO: 43200 - DNA, 26 bp, Artificial Sequence
  Synthetic Construct
gcccagcaagaaactattcctaccta

SEQ ID NO: 43201 - DNA, 19 bp, Artificial Sequence
  Synthetic Construct
agccgtccagccgtgaaca

SEQ ID NO: 43202 - DNA, 26 bp, Artificial Sequence
  Synthetic Construct
gccgatgacaaacagacctctaggaa

SEQ ID NO: 43203 - DNA, 21 bp, Artificial Sequence
  Synthetic Construct
cccactgcagaaacggtccta

SEQ ID NO: 43204 - DNA, 22 bp, Artificial Sequence
  Synthetic Construct
cagagttgggaggtggaagaca

SEQ ID NO: 43205 - DNA, 25 bp, Artificial Sequence
  Synthetic Construct
ggcagaaatctttgctgttgagtga

SEQ ID NO: 43206 - DNA, 21 bp, Artificial Sequence
  Synthetic Construct
ttgggcttcccagtccccttt

SEQ ID NO: 43207 - DNA, 23 bp, Artificial Sequence
  Synthetic Construct
ccagtaaagcctgtttgctctct

SEQ ID NO: 43208 - DNA, 20 bp, Artificial Sequence
  Synthetic Construct
ctgctggctttgccacttgt

SEQ ID NO: 43209 - DNA, 21 bp, Artificial Sequence
  Synthetic Construct
tggcatggacgctgtggatag

SEQ ID NO: 43210 - DNA, 21 bp, Artificial Sequence
  Synthetic Construct
aaagcctctgggagcctctct

SEQ ID NO: 43211 - DNA, 20 bp, Artificial Sequence
  Synthetic Construct
gcatccagcccaacccctaa

SEQ ID NO: 43212 - DNA, 23 bp, Artificial Sequence
  Synthetic Construct
cctgcaaatgtggctgctgttag

SEQ ID NO: 43213 - DNA, 25 bp, Artificial Sequence
  Synthetic Construct
ccagctgaattctaagcctcacaca

SEQ ID NO: 43214 - DNA, 22 bp, Artificial Sequence
  Synthetic Construct
ggaccctctgggttcaaagcta

SEQ ID NO: 43215 - DNA, 23 bp, Artificial Sequence
  Synthetic Construct
ggtggcaactttagcctctgaac

SEQ ID NO: 43216 - DNA, 23 bp, Artificial Sequence
  Synthetic Construct
gaggccatgtctcaaaacacaca

SEQ ID NO: 43217 - DNA, 20 bp, Artificial Sequence
  Synthetic Construct
cacgtttcccggatcctcaa

SEQ ID NO: 43218 - DNA, 26 bp, Artificial Sequence
  Synthetic Construct
ctgggtaccagaaaagtggaatgtct

SEQ ID NO: 43219 - DNA, 22 bp, Artificial Sequence
  Synthetic Construct
aggtcggagggagaatgagtga

SEQ ID NO: 43220 - DNA, 21 bp, Artificial Sequence
  Synthetic Construct
gtgaggcaacgcctaagttct

SEQ ID NO: 43221 - DNA, 30 bp, Artificial Sequence
  Synthetic Construct
gcctcattctctttctttcaaaccgagttc

SEQ ID NO: 43222 - DNA, 21 bp, Artificial Sequence
  Synthetic Construct
accccgaccagtggagacttt

SEQ ID NO: 43223 - DNA, 24 bp, Artificial Sequence
  Synthetic Construct
cagtcaccacaacctcaatgtaga

SEQ ID NO: 43224 - DNA, 25 bp, Artificial Sequence
  Synthetic Construct
gcttatggcacagggttttgtgaag

SEQ ID NO: 43225 - DNA, 22 bp, Artificial Sequence
  Synthetic Construct
agcgtccctccaaccttagtgt

SEQ ID NO: 43226 - DNA, 24 bp, Artificial Sequence
  Synthetic Construct
gacagcagctgacggtttaagttc

SEQ ID NO: 43227 - DNA, 22 bp, Artificial Sequence
  Synthetic Construct
gagagtgcttttggctcagaga

SEQ ID NO: 43228 - DNA, 24 bp, Artificial Sequence
  Synthetic Construct
cccagggaaactggttcaaagaca

SEQ ID NO: 43229 - DNA, 22 bp, Artificial Sequence
  Synthetic Construct
tggggagacctatgggctttac

SEQ ID NO: 43230 - DNA, 23 bp, Artificial Sequence
  Synthetic Construct
ggagtgaacccagaaggctttga

SEQ ID NO: 43231 - DNA, 20 bp, Artificial Sequence
  Synthetic Construct
atgcccactgcactctctct

SEQ ID NO: 43232 - DNA, 24 bp, Artificial Sequence
  Synthetic Construct
attttcttcctaaccaccggcata

SEQ ID NO: 43233 - DNA, 20 bp, Artificial Sequence
  Synthetic Construct
aaggggctgaggtgggagaa

SEQ ID NO: 43234 - DNA, 23 bp, Artificial Sequence
  Synthetic Construct
gggatgtacttcgtggggtgtag

SEQ ID NO: 43235 - DNA, 24 bp, Artificial Sequence
  Synthetic Construct
tgagcaaaccaaacggatgtatgt

SEQ ID NO: 43236 - DNA, 28 bp, Artificial Sequence
  Synthetic Construct
gctgtgtgattgacagatcttcctgtga

SEQ ID NO: 43237 - DNA, 22 bp, Artificial Sequence
  Synthetic Construct
gtgatgacagttggctgacgat

SEQ ID NO: 43238 - DNA, 24 bp, Artificial Sequence
  Synthetic Construct
tgatcgtctctaccccttgaaact

SEQ ID NO: 43239 - DNA, 20 bp, Artificial Sequence
  Synthetic Construct
cctctgccacaggtgaccaa

SEQ ID NO: 43240 - DNA, 27 bp, Artificial Sequence
  Synthetic Construct
agatctgagtaatgtctctggaagtga

SEQ ID NO: 43241 - DNA, 20 bp, Artificial Sequence
  Synthetic Construct
cctggccgtggagttggttt

SEQ ID NO: 43242 - DNA, 20 bp, Artificial Sequence
  Synthetic Construct
tcccatcgcccaggtacaga

SEQ ID NO: 43243 - DNA, 22 bp, Artificial Sequence
  Synthetic Construct
ccatctggaaccacctggtgaa

SEQ ID NO: 43244 - DNA, 23 bp, Artificial Sequence
  Synthetic Construct
cccagttttcagatcccagttgt

SEQ ID NO: 43245 - DNA, 19 bp, Artificial Sequence
  Synthetic Construct
gggtgggtggtgaggagat

SEQ ID NO: 43246 - DNA, 24 bp, Artificial Sequence
  Synthetic Construct
ccagggctttacacacacagagaa

SEQ ID NO: 43247 - DNA, 24 bp, Artificial Sequence
  Synthetic Construct
tcagtggtctatgcaagcctaatc

SEQ ID NO: 43248 - DNA, 25 bp, Artificial Sequence
  Synthetic Construct
cgatgtaagggtgcaggagaacaga

SEQ ID NO: 43249 - DNA, 21 bp, Artificial Sequence
  Synthetic Construct
tcctcatgctcctcgtggaat

SEQ ID NO: 43250 - DNA, 20 bp, Artificial Sequence
  Synthetic Construct
ctgcaaatgacgccctctga

SEQ ID NO: 43251 - DNA, 24 bp, Artificial Sequence
  Synthetic Construct
gctttgagctggtatggagaacaa

SEQ ID NO: 43252 - DNA, 24 bp, Artificial Sequence
  Synthetic Construct
gaccttccagaagaccctctcttg

SEQ ID NO: 43253 - DNA, 21 bp, Artificial Sequence
  Synthetic Construct
gccgatcaccctgcattcctt

SEQ ID NO: 43254 - DNA, 22 bp, Artificial Sequence
  Synthetic Construct
gcctgaagaggacgaactgttg

SEQ ID NO: 43255 - DNA, 23 bp, Artificial Sequence
  Synthetic Construct
gggtgcctggaggaataccaatc

SEQ ID NO: 43256 - DNA, 23 bp, Artificial Sequence
  Synthetic Construct
gtgcaagctatgcaagggtgatg

SEQ ID NO: 43257 - DNA, 26 bp, Artificial Sequence
  Synthetic Construct
acagaaaaggagttaagagggagttg

SEQ ID NO: 43258 - DNA, 24 bp, Artificial Sequence
  Synthetic Construct
gagcttagaaaactctgcctctga

SEQ ID NO: 43259 - DNA, 23 bp, Artificial Sequence
  Synthetic Construct
aacagactcctgcttcctcattc

SEQ ID NO: 43260 - DNA, 19 bp, Artificial Sequence
  Synthetic Construct
aagccacggacgggtacta

SEQ ID NO: 43261 - DNA, 22 bp, Artificial Sequence
  Synthetic Construct
tgtccactcttgactgcctcta

SEQ ID NO: 43262 - DNA, 20 bp, Artificial Sequence
  Synthetic Construct
gcatgcagccacaaggaaca

SEQ ID NO: 43263 - DNA, 22 bp, Artificial Sequence
  Synthetic Construct
tgatcctcctcagcttcgtttg

SEQ ID NO: 43264 - DNA, 24 bp, Artificial Sequence
  Synthetic Construct
gctggttccagaggagtaggactt

SEQ ID NO: 43265 - DNA, 22 bp, Artificial Sequence
  Synthetic Construct
gcaggctggctgatttccaaca

SEQ ID NO: 43266 - DNA, 27 bp, Artificial Sequence
  Synthetic Construct
gcctgttaataaaggtgttgggtctga

SEQ ID NO: 43267 - DNA, 23 bp, Artificial Sequence
  Synthetic Construct
ctccaaggctcttatcccaggaa

SEQ ID NO: 43268 - DNA, 21 bp, Artificial Sequence
  Synthetic Construct
ccccgatctccgagtacagat

SEQ ID NO: 43269 - DNA, 21 bp, Artificial Sequence
  Synthetic Construct
tccagttccacatgcctccta

SEQ ID NO: 43270 - DNA, 20 bp, Artificial Sequence
  Synthetic Construct
gacagcacagcaccactttg

SEQ ID NO: 43271 - DNA, 26 bp, Artificial Sequence
  Synthetic Construct
cagatcactgtagttctctccagtct

SEQ ID NO: 43272 - DNA, 21 bp, Artificial Sequence
  Synthetic Construct
ccaaggaagccctgagtccat

SEQ ID NO: 43273 - DNA, 22 bp, Artificial Sequence
  Synthetic Construct
gcacatccagcgcaaactggta

SEQ ID NO: 43274 - DNA, 24 bp, Artificial Sequence
  Synthetic Construct
ggtgtgggcgtgaatatagaccaa

SEQ ID NO: 43275 - DNA, 22 bp, Artificial Sequence
  Synthetic Construct
cctcaccgccgtgtcatttgaa

SEQ ID NO: 43276 - DNA, 23 bp, Artificial Sequence
  Synthetic Construct
ggcagttacctcctccaacattc

SEQ ID NO: 43277 - DNA, 25 bp, Artificial Sequence
  Synthetic Construct
ggaaccacaggtgaaatagggaagt

SEQ ID NO: 43278 - DNA, 22 bp, Artificial Sequence
  Synthetic Construct
gctttgtcaaatggcccagcta

SEQ ID NO: 43279 - DNA, 21 bp, Artificial Sequence
  Synthetic Construct
ggaacatccctcagccaaaca

SEQ ID NO: 43280 - DNA, 25 bp, Artificial Sequence
  Synthetic Construct
gctttccaaagagatctaggacaca

SEQ ID NO: 43281 - DNA, 21 bp, Artificial Sequence
  Synthetic Construct
ggttctccacgggaccctttc

SEQ ID NO: 43282 - DNA, 25 bp, Artificial Sequence
  Synthetic Construct
ctccaaggaggaccaattctcttgt

SEQ ID NO: 43283 - DNA, 23 bp, Artificial Sequence
  Synthetic Construct
caatgactggatgtgtggctctt

SEQ ID NO: 43284 - DNA, 23 bp, Artificial Sequence
  Synthetic Construct
gagaagactgcacctgaccatac

SEQ ID NO: 43285 - DNA, 25 bp, Artificial Sequence
  Synthetic Construct
gcagagccaacttttaaacccagat

SEQ ID NO: 43286 - DNA, 23 bp, Artificial Sequence
  Synthetic Construct
tgcatgtcccagagctctatact

SEQ ID NO: 43287 - DNA, 21 bp, Artificial Sequence
  Synthetic Construct
ccccacattccatgcctgcta

SEQ ID NO: 43288 - DNA, 25 bp, Artificial Sequence
  Synthetic Construct
ccaggacatctacatgcaggagctt

SEQ ID NO: 43289 - DNA, 25 bp, Artificial Sequence
  Synthetic Construct
aacaagagaactggacccttagttc

SEQ ID NO: 43290 - DNA, 25 bp, Artificial Sequence
  Synthetic Construct
gttaacttcagcatggcagaaaaac

SEQ ID NO: 43291 - DNA, 22 bp, Artificial Sequence
  Synthetic Construct
ttatggagcgcatgtacacagt

SEQ ID NO: 43292 - DNA, 21 bp, Artificial Sequence
  Synthetic Construct
gccccagtgactcacaccaat

SEQ ID NO: 43293 - DNA, 21 bp, Artificial Sequence
  Synthetic Construct
ccaggaccgacgttgtcatct

SEQ ID NO: 43294 - DNA, 21 bp, Artificial Sequence
  Synthetic Construct
gccttggtttgctctctgcaa

SEQ ID NO: 43295 - DNA, 22 bp, Artificial Sequence
  Synthetic Construct
cggtcaggccttctcttggttt

SEQ ID NO: 43296 - DNA, 22 bp, Artificial Sequence
  Synthetic Construct
cactttcagtgcaggtggtttg

SEQ ID NO: 43297 - DNA, 22 bp, Artificial Sequence
  Synthetic Construct
ggagcagccacagatcctttgt

SEQ ID NO: 43298 - DNA, 24 bp, Artificial Sequence
  Synthetic Construct
gtctttcaaaggcaaactccactt

SEQ ID NO: 43299 - DNA, 24 bp, Artificial Sequence
  Synthetic Construct
ggtcagcttatccactctggattc

SEQ ID NO: 43300 - DNA, 21 bp, Artificial Sequence
  Synthetic Construct
tgcaaactagggaaccagcaa

SEQ ID NO: 43301 - DNA, 20 bp, Artificial Sequence
  Synthetic Construct
ccctgagaagcggcagtgtt

SEQ ID NO: 43302 - DNA, 25 bp, Artificial Sequence
  Synthetic Construct
ggagtcaggtctaaggaagtctgta

SEQ ID NO: 43303 - DNA, 24 bp, Artificial Sequence
  Synthetic Construct
ggccagaagaagcacttccccttt

SEQ ID NO: 43304 - DNA, 20 bp, Artificial Sequence
  Synthetic Construct
agggcagggtaggggacata

SEQ ID NO: 43305 - DNA, 21 bp, Artificial Sequence
  Synthetic Construct
tccctttccctggttgagctt

SEQ ID NO: 43306 - DNA, 21 bp, Artificial Sequence
  Synthetic Construct
tggcaagtgtgtccaaggaat

SEQ ID NO: 43307 - DNA, 20 bp, Artificial Sequence
  Synthetic Construct
tctccaccctcgccccaaca

SEQ ID NO: 43308 - DNA, 23 bp, Artificial Sequence
  Synthetic Construct
gttgttagcccagaaacgcaatg

SEQ ID NO: 43309 - DNA, 22 bp, Artificial Sequence
  Synthetic Construct
cctgttggactctgctccattg

SEQ ID NO: 43310 - DNA, 24 bp, Artificial Sequence
  Synthetic Construct
caaggttcttggaaaccacaacaa

SEQ ID NO: 43311 - DNA, 23 bp, Artificial Sequence
  Synthetic Construct
agtagagagacaccctccagttt

SEQ ID NO: 43312 - DNA, 24 bp, Artificial Sequence
  Synthetic Construct
gaaccctataggctcactccaaag

SEQ ID NO: 43313 - DNA, 21 bp, Artificial Sequence
  Synthetic Construct
cccagccatgttggcatcaga

SEQ ID NO: 43314 - DNA, 24 bp, Artificial Sequence
  Synthetic Construct
caggggaggttttactttcgcata

SEQ ID NO: 43315 - DNA, 20 bp, Artificial Sequence
  Synthetic Construct
tcgacccgaggagggaccaa

SEQ ID NO: 43316 - DNA, 21 bp, Artificial Sequence
  Synthetic Construct
atcgctgaggccagggcttac

SEQ ID NO: 43317 - DNA, 21 bp, Artificial Sequence
  Synthetic Construct
aagcagggagacaggctgtga

SEQ ID NO: 43318 - DNA, 20 bp, Artificial Sequence
  Synthetic Construct
caacggcagcgtcttcacta

SEQ ID NO: 43319 - DNA, 22 bp, Artificial Sequence
  Synthetic Construct
ggcattgcggacacaggtctat

SEQ ID NO: 43320 - DNA, 26 bp, Artificial Sequence
  Synthetic Construct
ctcctgtagtcaacaactgattgcat

SEQ ID NO: 43321 - DNA, 19 bp, Artificial Sequence
  Synthetic Construct
cccgggtaagcctgcagta

SEQ ID NO: 43322 - DNA, 24 bp, Artificial Sequence
  Synthetic Construct
ctccatggtttctggggttctttc

SEQ ID NO: 43323 - DNA, 22 bp, Artificial Sequence
  Synthetic Construct
aggccactgagtaggacagtga

SEQ ID NO: 43324 - DNA, 21 bp, Artificial Sequence
  Synthetic Construct
catgccaaccaagctgcaaag

SEQ ID NO: 43325 - DNA, 21 bp, Artificial Sequence
  Synthetic Construct
gccctgtagcccacctcttta

SEQ ID NO: 43326 - DNA, 28 bp, Artificial Sequence
  Synthetic Construct
ccagtacacagcagagctggtatttaag

SEQ ID NO: 43327 - DNA, 22 bp, Artificial Sequence
  Synthetic Construct
ctcaacacaggatctggtccaa

SEQ ID NO: 43328 - DNA, 25 bp, Artificial Sequence
  Synthetic Construct
gggctcaagagcttaggctgtttct

SEQ ID NO: 43329 - DNA, 23 bp, Artificial Sequence
  Synthetic Construct
ggagcacacacacctgaaacttg

SEQ ID NO: 43330 - DNA, 20 bp, Artificial Sequence
  Synthetic Construct
tgccagccatgcagtgtcaa

SEQ ID NO: 43331 - DNA, 21 bp, Artificial Sequence
  Synthetic Construct
tcaacaatgccagcactcaca

SEQ ID NO: 43332 - DNA, 20 bp, Artificial Sequence
  Synthetic Construct
aggaaccaggaggcatgtgt

SEQ ID NO: 43333 - DNA, 27 bp, Artificial Sequence
  Synthetic Construct
cagagaggattgcatggatcttcatag

SEQ ID NO: 43334 - DNA, 25 bp, Artificial Sequence
  Synthetic Construct
cctgtggtttctactgcttagagtt

SEQ ID NO: 43335 - DNA, 25 bp, Artificial Sequence
  Synthetic Construct
gaaacctgaaaacgtgagcattagt

SEQ ID NO: 43336 - DNA, 22 bp, Artificial Sequence
  Synthetic Construct
cagtaccctggactgtcagcaa

SEQ ID NO: 43337 - DNA, 26 bp, Artificial Sequence
  Synthetic Construct
gtgaaaacgaggaaactgagatccaa

SEQ ID NO: 43338 - DNA, 22 bp, Artificial Sequence
  Synthetic Construct
ctgtcattggggaggtttggaa

SEQ ID NO: 43339 - DNA, 21 bp, Artificial Sequence
  Synthetic Construct
gggacagttggctgttaggtt

SEQ ID NO: 43340 - DNA, 22 bp, Artificial Sequence
  Synthetic Construct
agagctcagctgccttccatag

SEQ ID NO: 43341 - DNA, 22 bp, Artificial Sequence
  Synthetic Construct
cacgtccccagtttctctggaa

SEQ ID NO: 43342 - DNA, 24 bp, Artificial Sequence
  Synthetic Construct
gtccactgattgttgagggctaga

SEQ ID NO: 43343 - DNA, 22 bp, Artificial Sequence
  Synthetic Construct
ccacaccataaggctggagcta

SEQ ID NO: 43344 - DNA, 28 bp, Artificial Sequence
  Synthetic Construct
cctgcctgaaaaattaagccatgacagt

SEQ ID NO: 43345 - DNA, 21 bp, Artificial Sequence
  Synthetic Construct
ccccaataccacacactgcat

SEQ ID NO: 43346 - DNA, 25 bp, Artificial Sequence
  Synthetic Construct
cagaggaacagaatgaaacctcagt

SEQ ID NO: 43347 - DNA, 23 bp, Artificial Sequence
  Synthetic Construct
tgaatcgtgtcctggttgtgaag

SEQ ID NO: 43348 - DNA, 20 bp, Artificial Sequence
  Synthetic Construct
ggctgcatgcaagaggattg

SEQ ID NO: 43349 - DNA, 19 bp, Artificial Sequence
  Synthetic Construct
aacagaagcgcagccagaa

SEQ ID NO: 43350 - DNA, 24 bp, Artificial Sequence
  Synthetic Construct
cctcagttaccgtctgcttacatc

SEQ ID NO: 43351 - DNA, 26 bp, Artificial Sequence
  Synthetic Construct
ctccattacagatagcactcttcact

SEQ ID NO: 43352 - DNA, 21 bp, Artificial Sequence
  Synthetic Construct
ccacaacccacagtcccttca

SEQ ID NO: 43353 - DNA, 25 bp, Artificial Sequence
  Synthetic Construct
gatttggacctgatcagtcttgaca

SEQ ID NO: 43354 - DNA, 20 bp, Artificial Sequence
  Synthetic Construct
tggactagtgcctgcctgtt

SEQ ID NO: 43355 - DNA, 23 bp, Artificial Sequence
  Synthetic Construct
ccatctgtccctcttggtgaatg

SEQ ID NO: 43356 - DNA, 25 bp, Artificial Sequence
  Synthetic Construct
gcatagcaaagtggtaagtttggaa

SEQ ID NO: 43357 - DNA, 23 bp, Artificial Sequence
  Synthetic Construct
caatcctttatggcgcaggaatg

SEQ ID NO: 43358 - DNA, 25 bp, Artificial Sequence
  Synthetic Construct
ctccaaaatctggtcacctcctttg

SEQ ID NO: 43359 - DNA, 21 bp, Artificial Sequence
  Synthetic Construct
atctgcaggggcccagataca

SEQ ID NO: 43360 - DNA, 25 bp, Artificial Sequence
  Synthetic Construct
cccatcaaaactcctgtctttggaa

SEQ ID NO: 43361 - DNA, 22 bp, Artificial Sequence
  Synthetic Construct
gccaagcaagctttcccgaaca

SEQ ID NO: 43362 - DNA, 19 bp, Artificial Sequence
  Synthetic Construct
cctgcactgtgggctggaa

SEQ ID NO: 43363 - DNA, 22 bp, Artificial Sequence
  Synthetic Construct
aagtccaaagggcctgggtatc

SEQ ID NO: 43364 - DNA, 22 bp, Artificial Sequence
  Synthetic Construct
ggaatcaccttcagcgcattac

SEQ ID NO: 43365 - DNA, 23 bp, Artificial Sequence
  Synthetic Construct
ggagcaacatacagaggggattg

SEQ ID NO: 43366 - DNA, 20 bp, Artificial Sequence
  Synthetic Construct
aaatggtgcctggggctgaa

SEQ ID NO: 43367 - DNA, 21 bp, Artificial Sequence
  Synthetic Construct
gcccacaccacttcacctttg

SEQ ID NO: 43368 - DNA, 22 bp, Artificial Sequence
  Synthetic Construct
aggggagcaggaaataggaaca

SEQ ID NO: 43369 - DNA, 23 bp, Artificial Sequence
  Synthetic Construct
caggaagcctgagcaaagtaagt

SEQ ID NO: 43370 - DNA, 22 bp, Artificial Sequence
  Synthetic Construct
gtgcaatgtcctagggctgagt

SEQ ID NO: 43371 - DNA, 19 bp, Artificial Sequence
  Synthetic Construct
aggtggggtgtggaaggat

SEQ ID NO: 43372 - DNA, 24 bp, Artificial Sequence
  Synthetic Construct
ccccagagatagcctggaaaccaa

SEQ ID NO: 43373 - DNA, 25 bp, Artificial Sequence
  Synthetic Construct
ggatacagatgtgggactcaaagat

SEQ ID NO: 43374 - DNA, 21 bp, Artificial Sequence
  Synthetic Construct
tcagagcccagggttcaagtt

SEQ ID NO: 43375 - DNA, 20 bp, Artificial Sequence
  Synthetic Construct
ggctcccaccctccaaaaca

SEQ ID NO: 43376 - DNA, 20 bp, Artificial Sequence
  Synthetic Construct
caagcagtgccagagcatgt

SEQ ID NO: 43377 - DNA, 24 bp, Artificial Sequence
  Synthetic Construct
ggggacataaatgcacccttggaa

SEQ ID NO: 43378 - DNA, 26 bp, Artificial Sequence
  Synthetic Construct
cttagtacttgagacattggctgtca

SEQ ID NO: 43379 - DNA, 26 bp, Artificial Sequence
  Synthetic Construct
gggtaccagaggcatgattagccata

SEQ ID NO: 43380 - DNA, 23 bp, Artificial Sequence
  Synthetic Construct
gggaatttacaccctgcagttga

SEQ ID NO: 43381 - DNA, 23 bp, Artificial Sequence
  Synthetic Construct
aggctgggaaactcaggtttaag

SEQ ID NO: 43382 - DNA, 22 bp, Artificial Sequence
  Synthetic Construct
gcttctgccaatgggcttgagt

SEQ ID NO: 43383 - DNA, 25 bp, Artificial Sequence
  Synthetic Construct
cctgggagttgcttaattgccagat

SEQ ID NO: 43384 - DNA, 25 bp, Artificial Sequence
  Synthetic Construct
ttctctttctgttttggctgggata

SEQ ID NO: 43385 - DNA, 23 bp, Artificial Sequence
  Synthetic Construct
gccccatcaatcctagtcagttg

SEQ ID NO: 43386 - DNA, 22 bp, Artificial Sequence
  Synthetic Construct
ggcatccgtcattgccaaggta

SEQ ID NO: 43387 - DNA, 21 bp, Artificial Sequence
  Synthetic Construct
tggcttgaggccaggagtttg

SEQ ID NO: 43388 - DNA, 23 bp, Artificial Sequence
  Synthetic Construct
caaagcccatttgtagcacactt

SEQ ID NO: 43389 - DNA, 25 bp, Artificial Sequence
  Synthetic Construct
cagaaaacacaggggctagaacaac

SEQ ID NO: 43390 - DNA, 19 bp, Artificial Sequence
  Synthetic Construct
tgcagcctgtgacgtgtgt

SEQ ID NO: 43391 - DNA, 23 bp, Artificial Sequence
  Synthetic Construct
gcagttagcattgtcccaaccaa

SEQ ID NO: 43392 - DNA, 20 bp, Artificial Sequence
  Synthetic Construct
tagggcaggcaggactggtt

SEQ ID NO: 43393 - DNA, 22 bp, Artificial Sequence
  Synthetic Construct
tgtgcttaaagagcctgagcaa

SEQ ID NO: 43394 - DNA, 22 bp, Artificial Sequence
  Synthetic Construct
ccctgtgatgggccctagtttt

SEQ ID NO: 43395 - DNA, 24 bp, Artificial Sequence
  Synthetic Construct
tgttgggctaaggctaaggttaag

SEQ ID NO: 43396 - DNA, 21 bp, Artificial Sequence
  Synthetic Construct
ctggaggaaattgccctgctt

SEQ ID NO: 43397 - DNA, 20 bp, Artificial Sequence
  Synthetic Construct
tgtgagtcgtgcggtgactt

SEQ ID NO: 43398 - DNA, 23 bp, Artificial Sequence
  Synthetic Construct
gtctgcatttgccttttgctgaa

SEQ ID NO: 43399 - DNA, 22 bp, Artificial Sequence
  Synthetic Construct
cacagacgagtccctctcaatg

SEQ ID NO: 43400 - DNA, 24 bp, Artificial Sequence
  Synthetic Construct
ggactcttgcaattctaggcaaag

SEQ ID NO: 43401 - DNA, 25 bp, Artificial Sequence
  Synthetic Construct
tgacaaaaggaaggaacaacctcat

SEQ ID NO: 43402 - DNA, 22 bp, Artificial Sequence
  Synthetic Construct
cttcccacaaaccccacaatga

SEQ ID NO: 43403 - DNA, 24 bp, Artificial Sequence
  Synthetic Construct
tttccactcttcaacaggacttga

SEQ ID NO: 43404 - DNA, 25 bp, Artificial Sequence
  Synthetic Construct
cactggaatcctatttccacagtga

SEQ ID NO: 43405 - DNA, 22 bp, Artificial Sequence
  Synthetic Construct
ggagcaggattcagggaagaca

SEQ ID NO: 43406 - DNA, 22 bp, Artificial Sequence
  Synthetic Construct
gctgaacatctgtgctggttga

SEQ ID NO: 43407 - DNA, 21 bp, Artificial Sequence
  Synthetic Construct
ctgtcctgtcccaagtgcttt

SEQ ID NO: 43408 - DNA, 22 bp, Artificial Sequence
  Synthetic Construct
agtgggaaggccagggataaag

SEQ ID NO: 43409 - DNA, 22 bp, Artificial Sequence
  Synthetic Construct
gacaggaaactcctcagtgcaa

SEQ ID NO: 43410 - DNA, 22 bp, Artificial Sequence
  Synthetic Construct
gaggtaatgcctagctgcaaca

SEQ ID NO: 43411 - DNA, 24 bp, Artificial Sequence
  Synthetic Construct
tcgagcctatccattctagcttct

SEQ ID NO: 43412 - DNA, 19 bp, Artificial Sequence
  Synthetic Construct
tgtgtgcctgccaggtagt

SEQ ID NO: 43413 - DNA, 20 bp, Artificial Sequence
  Synthetic Construct
taccctcgtagccgcaagta

SEQ ID NO: 43414 - DNA, 25 bp, Artificial Sequence
  Synthetic Construct
gaagactgcttcaaaaaggcagatg

SEQ ID NO: 43415 - DNA, 22 bp, Artificial Sequence
  Synthetic Construct
actgcaggagtgactgagattg

SEQ ID NO: 43416 - DNA, 22 bp, Artificial Sequence
  Synthetic Construct
gcaatccctggttcagcagaca

SEQ ID NO: 43417 - DNA, 20 bp, Artificial Sequence
  Synthetic Construct
gagcaagccctggaaacagt

SEQ ID NO: 43418 - DNA, 24 bp, Artificial Sequence
  Synthetic Construct
agtaagggaaggaaaggccaaatg

SEQ ID NO: 43419 - DNA, 20 bp, Artificial Sequence
  Synthetic Construct
cagcaagccaagagctggtt

SEQ ID NO: 43420 - DNA, 26 bp, Artificial Sequence
  Synthetic Construct
cacatgaccccatactgtcttcaaac

SEQ ID NO: 43421 - DNA, 21 bp, Artificial Sequence
  Synthetic Construct
atggctgccctccctttgtgt

SEQ ID NO: 43422 - DNA, 26 bp, Artificial Sequence
  Synthetic Construct
cacttttaggggaacttggtggatct

SEQ ID NO: 43423 - DNA, 27 bp, Artificial Sequence
  Synthetic Construct
cagtactccatccagatctgacttcat

SEQ ID NO: 43424 - DNA, 25 bp, Artificial Sequence
  Synthetic Construct
cactctgtccaagtcctgctacatc

SEQ ID NO: 43425 - DNA, 26 bp, Artificial Sequence
  Synthetic Construct
gtgatagaaatccttgctcagagagt

SEQ ID NO: 43426 - DNA, 23 bp, Artificial Sequence
  Synthetic Construct
ggtctcacaagctctgcttccat

SEQ ID NO: 43427 - DNA, 27 bp, Artificial Sequence
  Synthetic Construct
tgatagatcgtgtggtgtaaaggttag

SEQ ID NO: 43428 - DNA, 19 bp, Artificial Sequence
  Synthetic Construct
cagctcacagtgcccagaa

SEQ ID NO: 43429 - DNA, 19 bp, Artificial Sequence
  Synthetic Construct
caggcacagcctggagaac

SEQ ID NO: 43430 - DNA, 22 bp, Artificial Sequence
  Synthetic Construct
aaacttcccatggacagagcaa

SEQ ID NO: 43431 - DNA, 23 bp, Artificial Sequence
  Synthetic Construct
ggcactgaagttaggtggagagt

SEQ ID NO: 43432 - DNA, 20 bp, Artificial Sequence
  Synthetic Construct
tggcactgcagccccaataa

SEQ ID NO: 43433 - DNA, 20 bp, Artificial Sequence
  Synthetic Construct
tgggcacagatgcagtgttg

SEQ ID NO: 43434 - DNA, 23 bp, Artificial Sequence
  Synthetic Construct
ctagaatactccccaggctcact

SEQ ID NO: 43435 - DNA, 20 bp, Artificial Sequence
  Synthetic Construct
accttgcctctggggactct

SEQ ID NO: 43436 - DNA, 22 bp, Artificial Sequence
  Synthetic Construct
ggaacacagaaagcctggaact

SEQ ID NO: 43437 - DNA, 27 bp, Artificial Sequence
  Synthetic Construct
gttgtaattctccaatcccaactgtca

SEQ ID NO: 43438 - DNA, 20 bp, Artificial Sequence
  Synthetic Construct
tcaagtcggggtgggaagaa

SEQ ID NO: 43439 - DNA, 24 bp, Artificial Sequence
  Synthetic Construct
cagaaaagtgactggaaagcaagt

SEQ ID NO: 43440 - DNA, 23 bp, Artificial Sequence
  Synthetic Construct
gtctttcccaaagcacaggatga

SEQ ID NO: 43441 - DNA, 25 bp, Artificial Sequence
  Synthetic Construct
tctgatgctgcttggaatagtttgt

SEQ ID NO: 43442 - DNA, 23 bp, Artificial Sequence
  Synthetic Construct
gcacgcttttaatcagggtgtag

SEQ ID NO: 43443 - DNA, 20 bp, Artificial Sequence
  Synthetic Construct
tgggaggaggacagccacaa

SEQ ID NO: 43444 - DNA, 20 bp, Artificial Sequence
  Synthetic Construct
cccagcacccactccaattt

SEQ ID NO: 43445 - DNA, 27 bp, Artificial Sequence
  Synthetic Construct
cacaggttaccttaatcaggcttggaa

SEQ ID NO: 43446 - DNA, 21 bp, Artificial Sequence
  Synthetic Construct
ggtggcaatgacagccaaaag

SEQ ID NO: 43447 - DNA, 25 bp, Artificial Sequence
  Synthetic Construct
cactcacatggttgttggctgttag

SEQ ID NO: 43448 - DNA, 24 bp, Artificial Sequence
  Synthetic Construct
ctttggcctgtatattgggtggta

SEQ ID NO: 43449 - DNA, 22 bp, Artificial Sequence
  Synthetic Construct
ctccaaatgtcagcagggtgtt

SEQ ID NO: 43450 - DNA, 23 bp, Artificial Sequence
  Synthetic Construct
cttggcttcagagtttccaggta

SEQ ID NO: 43451 - DNA, 21 bp, Artificial Sequence
  Synthetic Construct
agctggcaaggcaatttggat

SEQ ID NO: 43452 - DNA, 24 bp, Artificial Sequence
  Synthetic Construct
agaacaacacaggaatgtctgctt

SEQ ID NO: 43453 - DNA, 20 bp, Artificial Sequence
  Synthetic Construct
cgcttgtgctaccacctgta

SEQ ID NO: 43454 - DNA, 24 bp, Artificial Sequence
  Synthetic Construct
ccaaggaacctgacaattgctgaa

SEQ ID NO: 43455 - DNA, 24 bp, Artificial Sequence
  Synthetic Construct
cactgtgtgtgtccttcatcttgt

SEQ ID NO: 43456 - DNA, 25 bp, Artificial Sequence
  Synthetic Construct
ccacagcccattttaaccctacttg

SEQ ID NO: 43457 - DNA, 23 bp, Artificial Sequence
  Synthetic Construct
ggaagggaaggttgagtccatga

SEQ ID NO: 43458 - DNA, 20 bp, Artificial Sequence
  Synthetic Construct
acccatagggtgccgaactt

SEQ ID NO: 43459 - DNA, 18 bp, Artificial Sequence
  Synthetic Construct
agcaggcccagctcaaac

SEQ ID NO: 43460 - DNA, 24 bp, Artificial Sequence
  Synthetic Construct
ctgtgtgaaatcctccccaagaag

SEQ ID NO: 43461 - DNA, 23 bp, Artificial Sequence
  Synthetic Construct
gagtcctgatgtgtggtgcaatc

SEQ ID NO: 43462 - DNA, 19 bp, Artificial Sequence
  Synthetic Construct
actgctgaggcagcaacaa

SEQ ID NO: 43463 - DNA, 25 bp, Artificial Sequence
  Synthetic Construct
ggatttgctaccccagtgtttgagt

SEQ ID NO: 43464 - DNA, 21 bp, Artificial Sequence
  Synthetic Construct
tcccttgcccactgggagaaa

SEQ ID NO: 43465 - DNA, 24 bp, Artificial Sequence
  Synthetic Construct
gcaagctgtggctgaatagacaac

SEQ ID NO: 43466 - DNA, 24 bp, Artificial Sequence
  Synthetic Construct
gtgctcttcactctgtcaccaact

SEQ ID NO: 43467 - DNA, 23 bp, Artificial Sequence
  Synthetic Construct
tccacagcttcgaaactcttcat

SEQ ID NO: 43468 - DNA, 23 bp, Artificial Sequence
  Synthetic Construct
gggatttgctaccctccttctca

SEQ ID NO: 43469 - DNA, 20 bp, Artificial Sequence
  Synthetic Construct
gcctcctaggctgtgctgaa

SEQ ID NO: 43470 - DNA, 22 bp, Artificial Sequence
  Synthetic Construct
tgtgctccccgtaacctctaca

SEQ ID NO: 43471 - DNA, 20 bp, Artificial Sequence
  Synthetic Construct
ggactcagcgtcctctcctt

SEQ ID NO: 43472 - DNA, 26 bp, Artificial Sequence
  Synthetic Construct
gcaagttcatgtctgcttggatgtag

SEQ ID NO: 43473 - DNA, 30 bp, Artificial Sequence
  Synthetic Construct
ctcttgaaaatctatctacagggctaccaa

SEQ ID NO: 43474 - DNA, 23 bp, Artificial Sequence
  Synthetic Construct
cacatggcttttggagacgattc

SEQ ID NO: 43475 - DNA, 22 bp, Artificial Sequence
  Synthetic Construct
ggattgacccttccccagttac

SEQ ID NO: 43476 - DNA, 21 bp, Artificial Sequence
  Synthetic Construct
gcatgttccttgggtgggaat

SEQ ID NO: 43477 - DNA, 18 bp, Artificial Sequence
  Synthetic Construct
atgtggcaggcccagtga

SEQ ID NO: 43478 - DNA, 22 bp, Artificial Sequence
  Synthetic Construct
gcctgagttgacaggcggataa

SEQ ID NO: 43479 - DNA, 22 bp, Artificial Sequence
  Synthetic Construct
gctctgttagggcagaaaccat

SEQ ID NO: 43480 - DNA, 25 bp, Artificial Sequence
  Synthetic Construct
cccattgatacagcaccttggatga

SEQ ID NO: 43481 - DNA, 26 bp, Artificial Sequence
  Synthetic Construct
ctacttttcaaatcctccgacctaca

SEQ ID NO: 43482 - DNA, 23 bp, Artificial Sequence
  Synthetic Construct
ggtggtttgcaaggatgggttca

SEQ ID NO: 43483 - DNA, 25 bp, Artificial Sequence
  Synthetic Construct
gctccagatcccactcatagcattg

SEQ ID NO: 43484 - DNA, 20 bp, Artificial Sequence
  Synthetic Construct
attcccacacgccagcagaa

SEQ ID NO: 43485 - DNA, 24 bp, Artificial Sequence
  Synthetic Construct
gtcaacatacatagggccagaaca

SEQ ID NO: 43486 - DNA, 24 bp, Artificial Sequence
  Synthetic Construct
aaaactgacagggcttgatctttg

SEQ ID NO: 43487 - DNA, 22 bp, Artificial Sequence
  Synthetic Construct
ggaaggcacatggggcttttgt

SEQ ID NO: 43488 - DNA, 22 bp, Artificial Sequence
  Synthetic Construct
ccagcctttggagacctgtcaa

SEQ ID NO: 43489 - DNA, 21 bp, Artificial Sequence
  Synthetic Construct
tcaaagtccaggtgggtcaga

SEQ ID NO: 43490 - DNA, 18 bp, Artificial Sequence
  Synthetic Construct
aagccaggcgctcactca

SEQ ID NO: 43491 - DNA, 20 bp, Artificial Sequence
  Synthetic Construct
cctgggcttccgtgttctga

SEQ ID NO: 43492 - DNA, 21 bp, Artificial Sequence
  Synthetic Construct
gggcatgggtgtggaatgaca

SEQ ID NO: 43493 - DNA, 22 bp, Artificial Sequence
  Synthetic Construct
cacgtaacctctgccaccagat

SEQ ID NO: 43494 - DNA, 22 bp, Artificial Sequence
  Synthetic Construct
ccaccatacccaacctcagcat

SEQ ID NO: 43495 - DNA, 19 bp, Artificial Sequence
  Synthetic Construct
tggagtgctggagggcttt

SEQ ID NO: 43496 - DNA, 25 bp, Artificial Sequence
  Synthetic Construct
tggtccatatgcagatccagtaaag

SEQ ID NO: 43497 - DNA, 24 bp, Artificial Sequence
  Synthetic Construct
ccatgcatttttaggcaccagttc

SEQ ID NO: 43498 - DNA, 24 bp, Artificial Sequence
  Synthetic Construct
ccaacaaaagctggtttcccacat

SEQ ID NO: 43499 - DNA, 26 bp, Artificial Sequence
  Synthetic Construct
ggggataaaataggagcaaaccagat

SEQ ID NO: 43500 - DNA, 25 bp, Artificial Sequence
  Synthetic Construct
cagaagttccactgatagcttgtga

SEQ ID NO: 43501 - DNA, 19 bp, Artificial Sequence
  Synthetic Construct
taggcggccagccatctct

SEQ ID NO: 43502 - DNA, 18 bp, Artificial Sequence
  Synthetic Construct
tggtggtgggtgcagaga

SEQ ID NO: 43503 - DNA, 21 bp, Artificial Sequence
  Synthetic Construct
tggggctgccgatctcactaa

SEQ ID NO: 43504 - DNA, 22 bp, Artificial Sequence
  Synthetic Construct
agacatgttccctctccccaaa

SEQ ID NO: 43505 - DNA, 20 bp, Artificial Sequence
  Synthetic Construct
actgcatgccgtggttcttc

SEQ ID NO: 43506 - DNA, 26 bp, Artificial Sequence
  Synthetic Construct
gggagtggagtatttatgtccagtga

SEQ ID NO: 43507 - DNA, 19 bp, Artificial Sequence
  Synthetic Construct
atcactggagcgcttgctt

SEQ ID NO: 43508 - DNA, 23 bp, Artificial Sequence
  Synthetic Construct
ccaaagatcatgccaggagaaga

SEQ ID NO: 43509 - DNA, 27 bp, Artificial Sequence
  Synthetic Construct
ccatttccaggtaaaacagagggtatg

SEQ ID NO: 43510 - DNA, 26 bp, Artificial Sequence
  Synthetic Construct
cagtcaatacctgtctgacccaaatc

SEQ ID NO: 43511 - DNA, 22 bp, Artificial Sequence
  Synthetic Construct
aagatcggactggggaggtgtt

SEQ ID NO: 43512 - DNA, 26 bp, Artificial Sequence
  Synthetic Construct
ggttgtgattccatcaaactcgctaa

SEQ ID NO: 43513 - DNA, 21 bp, Artificial Sequence
  Synthetic Construct
gctgcctgggatttgaaggat

SEQ ID NO: 43514 - DNA, 20 bp, Artificial Sequence
  Synthetic Construct
ctgtgggcccaattcccatt

SEQ ID NO: 43515 - DNA, 26 bp, Artificial Sequence
  Synthetic Construct
ggcacagtaaacttgaaccagagcaa

SEQ ID NO: 43516 - DNA, 26 bp, Artificial Sequence
  Synthetic Construct
ggttattctacaaacaccccttcact

SEQ ID NO: 43517 - DNA, 26 bp, Artificial Sequence
  Synthetic Construct
ggacatatgtggaaggcaaacgtaag

SEQ ID NO: 43518 - DNA, 20 bp, Artificial Sequence
  Synthetic Construct
agagcaggaaggccagtgta

SEQ ID NO: 43519 - DNA, 20 bp, Artificial Sequence
  Synthetic Construct
tcagggtgatcagccagcta

SEQ ID NO: 43520 - DNA, 23 bp, Artificial Sequence
  Synthetic Construct
ggtcactatgtggcaaagcagtt

SEQ ID NO: 43521 - DNA, 21 bp, Artificial Sequence
  Synthetic Construct
ggctggcctaaaagggattct

SEQ ID NO: 43522 - DNA, 24 bp, Artificial Sequence
  Synthetic Construct
acatgatccacaacctttgacaac

SEQ ID NO: 43523 - DNA, 26 bp, Artificial Sequence
  Synthetic Construct
gctgaacaggaactaatcatcaccat

SEQ ID NO: 43524 - DNA, 22 bp, Artificial Sequence
  Synthetic Construct
agggaggatcactcctgcatct

SEQ ID NO: 43525 - DNA, 22 bp, Artificial Sequence
  Synthetic Construct
tcactcctcgaacctgttctct

SEQ ID NO: 43526 - DNA, 22 bp, Artificial Sequence
  Synthetic Construct
gtctgctatgagtctggtgctt

SEQ ID NO: 43527 - DNA, 20 bp, Artificial Sequence
  Synthetic Construct
ctggcaaagcgtgcttcact

SEQ ID NO: 43528 - DNA, 20 bp, Artificial Sequence
  Synthetic Construct
ggagtgcagtagtgcgtcat

SEQ ID NO: 43529 - DNA, 24 bp, Artificial Sequence
  Synthetic Construct
ccccacctagaatgtggtaactgt

SEQ ID NO: 43530 - DNA, 21 bp, Artificial Sequence
  Synthetic Construct
ccccagcagaggtgtgtttca

SEQ ID NO: 43531 - DNA, 22 bp, Artificial Sequence
  Synthetic Construct
cccaccctagcctgatgacaaa

SEQ ID NO: 43532 - DNA, 26 bp, Artificial Sequence
  Synthetic Construct
ccctgaacattgctattgctcccatt

SEQ ID NO: 43533 - DNA, 21 bp, Artificial Sequence
  Synthetic Construct
aatgcacagtccccgcacaac

SEQ ID NO: 43534 - DNA, 22 bp, Artificial Sequence
  Synthetic Construct
ggtggtcaggtggtggtaaatg

SEQ ID NO: 43535 - DNA, 26 bp, Artificial Sequence
  Synthetic Construct
gaaagttgattcccttacagctgagt

SEQ ID NO: 43536 - DNA, 28 bp, Artificial Sequence
  Synthetic Construct
ggtcctggcttagtaagatgacttccaa

SEQ ID NO: 43537 - DNA, 26 bp, Artificial Sequence
  Synthetic Construct
agtcagaaagagaagttggtgacatc

SEQ ID NO: 43538 - DNA, 21 bp, Artificial Sequence
  Synthetic Construct
tcccagaacagccctgacaga

SEQ ID NO: 43539 - DNA, 19 bp, Artificial Sequence
  Synthetic Construct
tgaggggcgagacccagat

SEQ ID NO: 43540 - DNA, 23 bp, Artificial Sequence
  Synthetic Construct
atcagcttgtgtgggaacttaca

SEQ ID NO: 43541 - DNA, 21 bp, Artificial Sequence
  Synthetic Construct
ccacttccaggcgtttgttca

SEQ ID NO: 43542 - DNA, 23 bp, Artificial Sequence
  Synthetic Construct
agcctgcaagtacattactgctt

SEQ ID NO: 43543 - DNA, 23 bp, Artificial Sequence
  Synthetic Construct
acacacacatggtccagaagttg

SEQ ID NO: 43544 - DNA, 28 bp, Artificial Sequence
  Synthetic Construct
gctttggaaagctacatccaagtcattg

SEQ ID NO: 43545 - DNA, 22 bp, Artificial Sequence
  Synthetic Construct
caggtggttcatgctggtgttg

SEQ ID NO: 43546 - DNA, 20 bp, Artificial Sequence
  Synthetic Construct
cccaacccaaggtggtcagt

SEQ ID NO: 43547 - DNA, 23 bp, Artificial Sequence
  Synthetic Construct
ggggcaactctgaaggacctttt

SEQ ID NO: 43548 - DNA, 23 bp, Artificial Sequence
  Synthetic Construct
ccactgggaatccaggagcattg

SEQ ID NO: 43549 - DNA, 22 bp, Artificial Sequence
  Synthetic Construct
ctggaggtcaggtccaatgtct

SEQ ID NO: 43550 - DNA, 20 bp, Artificial Sequence
  Synthetic Construct
tgagggagggagcccggttt

SEQ ID NO: 43551 - DNA, 29 bp, Artificial Sequence
  Synthetic Construct
cctacagcctaagaaagatctagaaccaa

SEQ ID NO: 43552 - DNA, 21 bp, Artificial Sequence
  Synthetic Construct
gttgggaaccagccctattgt

SEQ ID NO: 43553 - DNA, 27 bp, Artificial Sequence
  Synthetic Construct
gggcatatgataacatttggggagatg

SEQ ID NO: 43554 - DNA, 22 bp, Artificial Sequence
  Synthetic Construct
cgaacgctacacaggcatcctt

SEQ ID NO: 43555 - DNA, 26 bp, Artificial Sequence
  Synthetic Construct
gtaactacgcaatatgccttcacatc

SEQ ID NO: 43556 - DNA, 22 bp, Artificial Sequence
  Synthetic Construct
cgtgacaaggctgaaggtggta

SEQ ID NO: 43557 - DNA, 23 bp, Artificial Sequence
  Synthetic Construct
gggacatttcagaacccatgtct

SEQ ID NO: 43558 - DNA, 20 bp, Artificial Sequence
  Synthetic Construct
acacggcctacccaactaca

SEQ ID NO: 43559 - DNA, 25 bp, Artificial Sequence
  Synthetic Construct
ggctcagagagcaatttgggaatgt

SEQ ID NO: 43560 - DNA, 20 bp, Artificial Sequence
  Synthetic Construct
ttgcctagctggcaggtgta

SEQ ID NO: 43561 - DNA, 26 bp, Artificial Sequence
  Synthetic Construct
gcaggaggtgataaaagcaacagtga

SEQ ID NO: 43562 - DNA, 22 bp, Artificial Sequence
  Synthetic Construct
aaaacagcatcaggtcccatgt

SEQ ID NO: 43563 - DNA, 28 bp, Artificial Sequence
  Synthetic Construct
ggtcatttgattactttcgggaggacaa

SEQ ID NO: 43564 - DNA, 20 bp, Artificial Sequence
  Synthetic Construct
aggaggccagacagccagat

SEQ ID NO: 43565 - DNA, 25 bp, Artificial Sequence
  Synthetic Construct
ccctgtgtctttggtcacgtaactt

SEQ ID NO: 43566 - DNA, 22 bp, Artificial Sequence
  Synthetic Construct
gtctggctgtgacaagaactga

SEQ ID NO: 43567 - DNA, 23 bp, Artificial Sequence
  Synthetic Construct
ccgttatttttgaccgcatgctt

SEQ ID NO: 43568 - DNA, 24 bp, Artificial Sequence
  Synthetic Construct
gcctagaacctgttcccacaaagt

SEQ ID NO: 43569 - DNA, 23 bp, Artificial Sequence
  Synthetic Construct
gcccagtgattagcacaaagtga

SEQ ID NO: 43570 - DNA, 20 bp, Artificial Sequence
  Synthetic Construct
tcgggccagcttaccctatg

SEQ ID NO: 43571 - DNA, 19 bp, Artificial Sequence
  Synthetic Construct
tgccccaggctgaccatga

SEQ ID NO: 43572 - DNA, 24 bp, Artificial Sequence
  Synthetic Construct
caaggatgtttttccaggctgcta

SEQ ID NO: 43573 - DNA, 22 bp, Artificial Sequence
  Synthetic Construct
caaacagcaggtgtaggagtca

SEQ ID NO: 43574 - DNA, 25 bp, Artificial Sequence
  Synthetic Construct
ggaggaggagaagtgggtagagatg

SEQ ID NO: 43575 - DNA, 24 bp, Artificial Sequence
  Synthetic Construct
gaagtgtgagaggaacttgactga

SEQ ID NO: 43576 - DNA, 24 bp, Artificial Sequence
  Synthetic Construct
ggacccagtcaaagaactggaaca

SEQ ID NO: 43577 - DNA, 20 bp, Artificial Sequence
  Synthetic Construct
cgctctgggacactggaagt

SEQ ID NO: 43578 - DNA, 21 bp, Artificial Sequence
  Synthetic Construct
tcgccagtcactgctcctttg

SEQ ID NO: 43579 - DNA, 23 bp, Artificial Sequence
  Synthetic Construct
cctttcctcagacaggcttcatc

SEQ ID NO: 43580 - DNA, 24 bp, Artificial Sequence
  Synthetic Construct
gcctcctccagcctcccaatataa

SEQ ID NO: 43581 - DNA, 22 bp, Artificial Sequence
  Synthetic Construct
accctgtgacatgagggagaga

SEQ ID NO: 43582 - DNA, 23 bp, Artificial Sequence
  Synthetic Construct
gagctgattgcaggagacactac

SEQ ID NO: 43583 - DNA, 20 bp, Artificial Sequence
  Synthetic Construct
ggccaaaggccctgtgctat

SEQ ID NO: 43584 - DNA, 24 bp, Artificial Sequence
  Synthetic Construct
ccggctggtcttattaaccctaag

SEQ ID NO: 43585 - DNA, 26 bp, Artificial Sequence
  Synthetic Construct
ccccatagtataacttctcgcagctt

SEQ ID NO: 43586 - DNA, 27 bp, Artificial Sequence
  Synthetic Construct
ctggcattagatgagttgacagcctta

SEQ ID NO: 43587 - DNA, 22 bp, Artificial Sequence
  Synthetic Construct
gggtgctttcccttgagtgagt

SEQ ID NO: 43588 - DNA, 26 bp, Artificial Sequence
  Synthetic Construct
gcatgattgttccttagaagctgtag

SEQ ID NO: 43589 - DNA, 21 bp, Artificial Sequence
  Synthetic Construct
cccattggagaggctcacctt

SEQ ID NO: 43590 - DNA, 22 bp, Artificial Sequence
  Synthetic Construct
ccccgaccttgaactcaccaaa

SEQ ID NO: 43591 - DNA, 23 bp, Artificial Sequence
  Synthetic Construct
cctgggctggtccaacaactaag

SEQ ID NO: 43592 - DNA, 26 bp, Artificial Sequence
  Synthetic Construct
ggctctaacataacacacgcgtcact

SEQ ID NO: 43593 - DNA, 19 bp, Artificial Sequence
  Synthetic Construct
agcggagcccagtgagtta

SEQ ID NO: 43594 - DNA, 22 bp, Artificial Sequence
  Synthetic Construct
gtctgaccccactggattgtga

SEQ ID NO: 43595 - DNA, 26 bp, Artificial Sequence
  Synthetic Construct
gacattcagttcacaatctggagtca

SEQ ID NO: 43596 - DNA, 24 bp, Artificial Sequence
  Synthetic Construct
gaaaacactggacaaggagtcagt

SEQ ID NO: 43597 - DNA, 19 bp, Artificial Sequence
  Synthetic Construct
gccatcacgccaccagaca

SEQ ID NO: 43598 - DNA, 22 bp, Artificial Sequence
  Synthetic Construct
ccacagaccccagtttctgctt

SEQ ID NO: 43599 - DNA, 24 bp, Artificial Sequence
  Synthetic Construct
gcccagatctcccttccttgatct

SEQ ID NO: 43600 - DNA, 20 bp, Artificial Sequence
  Synthetic Construct
gcaaaaggctggggttgaga

SEQ ID NO: 43601 - DNA, 21 bp, Artificial Sequence
  Synthetic Construct
gtctcctggtgttacctgcaa

SEQ ID NO: 43602 - DNA, 23 bp, Artificial Sequence
  Synthetic Construct
gtggagtcagcaggagatgtgaa

SEQ ID NO: 43603 - DNA, 20 bp, Artificial Sequence
  Synthetic Construct
agtgcccactttcccactgt

SEQ ID NO: 43604 - DNA, 22 bp, Artificial Sequence
  Synthetic Construct
ggctctgtgctaaagggtggaa

SEQ ID NO: 43605 - DNA, 21 bp, Artificial Sequence
  Synthetic Construct
catgctgtgagcctgatgtga

SEQ ID NO: 43606 - DNA, 21 bp, Artificial Sequence
  Synthetic Construct
cacaggagcatatgcgggaaa

SEQ ID NO: 43607 - DNA, 22 bp, Artificial Sequence
  Synthetic Construct
actctatgccctccacacagat

SEQ ID NO: 43608 - DNA, 22 bp, Artificial Sequence
  Synthetic Construct
agctcctggtgtgtctgaggat

SEQ ID NO: 43609 - DNA, 24 bp, Artificial Sequence
  Synthetic Construct
gctttcaacagtcagcgtctctct

SEQ ID NO: 43610 - DNA, 26 bp, Artificial Sequence
  Synthetic Construct
ggtaccatcttagcctctccatgtct

SEQ ID NO: 43611 - DNA, 23 bp, Artificial Sequence
  Synthetic Construct
cgatatctcactccaccatgcaa

SEQ ID NO: 43612 - DNA, 22 bp, Artificial Sequence
  Synthetic Construct
cttgccgggtctgtctgtattg

SEQ ID NO: 43613 - DNA, 22 bp, Artificial Sequence
  Synthetic Construct
ggtcactgctttgcccaagact

SEQ ID NO: 43614 - DNA, 23 bp, Artificial Sequence
  Synthetic Construct
gcattctgagcttcaggggaagt

SEQ ID NO: 43615 - DNA, 22 bp, Artificial Sequence
  Synthetic Construct
ggtgaatagctgggtgctctga

SEQ ID NO: 43616 - DNA, 23 bp, Artificial Sequence
  Synthetic Construct
actgaatgaataagcccgctgaa

SEQ ID NO: 43617 - DNA, 24 bp, Artificial Sequence
  Synthetic Construct
gccagaggaagagatcctgccaaa

SEQ ID NO: 43618 - DNA, 24 bp, Artificial Sequence
  Synthetic Construct
ggcttgaattcctgcctagacctt

SEQ ID NO: 43619 - DNA, 27 bp, Artificial Sequence
  Synthetic Construct
gctaggtaggctacaggatgcagtaaa

SEQ ID NO: 43620 - DNA, 21 bp, Artificial Sequence
  Synthetic Construct
ggtgagcagcgagcttttaca

SEQ ID NO: 43621 - DNA, 23 bp, Artificial Sequence
  Synthetic Construct
cgcgtgagctgtttttaatgttg

SEQ ID NO: 43622 - DNA, 20 bp, Artificial Sequence
  Synthetic Construct
agggtcagatgcgtggtttg

SEQ ID NO: 43623 - DNA, 25 bp, Artificial Sequence
  Synthetic Construct
ggaaatagcctcttccatgggactt

SEQ ID NO: 43624 - DNA, 21 bp, Artificial Sequence
  Synthetic Construct
tggggtcagagccaagcagat

SEQ ID NO: 43625 - DNA, 22 bp, Artificial Sequence
  Synthetic Construct
tgtcagtcagggccaatcatac

SEQ ID NO: 43626 - DNA, 24 bp, Artificial Sequence
  Synthetic Construct
ggcaaggagtctcaatccctgcaa

SEQ ID NO: 43627 - DNA, 22 bp, Artificial Sequence
  Synthetic Construct
gcagggtctgatctccctcctt

SEQ ID NO: 43628 - DNA, 22 bp, Artificial Sequence
  Synthetic Construct
gagccttgtcaatgcggtaatg

SEQ ID NO: 43629 - DNA, 25 bp, Artificial Sequence
  Synthetic Construct
cacgcagtcagctaacacagtatct

SEQ ID NO: 43630 - DNA, 20 bp, Artificial Sequence
  Synthetic Construct
agggcagggacgacaaagtt

SEQ ID NO: 43631 - DNA, 22 bp, Artificial Sequence
  Synthetic Construct
ccaagacatggggctcttcctt

SEQ ID NO: 43632 - DNA, 19 bp, Artificial Sequence
  Synthetic Construct
aagctggctgcctgcaagt

SEQ ID NO: 43633 - DNA, 22 bp, Artificial Sequence
  Synthetic Construct
ctcagagctctccttccccttt

SEQ ID NO: 43634 - DNA, 18 bp, Artificial Sequence
  Synthetic Construct
ccccaatgcaggcgatga

SEQ ID NO: 43635 - DNA, 24 bp, Artificial Sequence
  Synthetic Construct
gcaggaagggtgaagtagcaggtt

SEQ ID NO: 43636 - DNA, 21 bp, Artificial Sequence
  Synthetic Construct
agaccagggtagctggagtga

SEQ ID NO: 43637 - DNA, 25 bp, Artificial Sequence
  Synthetic Construct
cctgagtagttgacagtgcgaggaa

SEQ ID NO: 43638 - DNA, 19 bp, Artificial Sequence
  Synthetic Construct
aagggcccaagacctggta

SEQ ID NO: 43639 - DNA, 22 bp, Artificial Sequence
  Synthetic Construct
cagttgtctggctgggacatga

SEQ ID NO: 43640 - DNA, 19 bp, Artificial Sequence
  Synthetic Construct
aggcaatccgctgttggtt

SEQ ID NO: 43641 - DNA, 20 bp, Artificial Sequence
  Synthetic Construct
agcacaaaagcagccacaga

SEQ ID NO: 43642 - DNA, 22 bp, Artificial Sequence
  Synthetic Construct
cctcagcacttacacggtgaca

SEQ ID NO: 43643 - DNA, 25 bp, Artificial Sequence
  Synthetic Construct
gggaggattacccacctaggttttg

SEQ ID NO: 43644 - DNA, 24 bp, Artificial Sequence
  Synthetic Construct
cagagtctgagcagtgtcttggaa

SEQ ID NO: 43645 - DNA, 20 bp, Artificial Sequence
  Synthetic Construct
ttctgctggggctggtgtta

SEQ ID NO: 43646 - DNA, 19 bp, Artificial Sequence
  Synthetic Construct
acactcgcgtgccactgat

SEQ ID NO: 43647 - DNA, 21 bp, Artificial Sequence
  Synthetic Construct
gcaagtctccaccagcctctt

SEQ ID NO: 43648 - DNA, 25 bp, Artificial Sequence
  Synthetic Construct
cccactcctaaatgtgtagggacta

SEQ ID NO: 43649 - DNA, 25 bp, Artificial Sequence
  Synthetic Construct
gagtagttcctccctactccagaga

SEQ ID NO: 43650 - DNA, 18 bp, Artificial Sequence
  Synthetic Construct
ttcctggccaccctcagt

SEQ ID NO: 43651 - DNA, 25 bp, Artificial Sequence
  Synthetic Construct
gcctgagggatcagtggaaacattg

SEQ ID NO: 43652 - DNA, 22 bp, Artificial Sequence
  Synthetic Construct
cgtgctcaaggcagagggttta

SEQ ID NO: 43653 - DNA, 23 bp, Artificial Sequence
  Synthetic Construct
gttttggagggagtgtgatgctt

SEQ ID NO: 43654 - DNA, 24 bp, Artificial Sequence
  Synthetic Construct
gagtcttagtctggtgtgcactga

SEQ ID NO: 43655 - DNA, 27 bp, Artificial Sequence
  Synthetic Construct
gccagtaaacagaagttgtcctgcaaa

SEQ ID NO: 43656 - DNA, 24 bp, Artificial Sequence
  Synthetic Construct
tgaattcgaaccatctacctgcaa

SEQ ID NO: 43657 - DNA, 26 bp, Artificial Sequence
  Synthetic Construct
gtgggttaaaagaggatggtggatga

SEQ ID NO: 43658 - DNA, 24 bp, Artificial Sequence
  Synthetic Construct
gcaggctgccatatttgctgtttc

SEQ ID NO: 43659 - DNA, 25 bp, Artificial Sequence
  Synthetic Construct
cattaaagagcacggtttcatcact

SEQ ID NO: 43660 - DNA, 24 bp, Artificial Sequence
  Synthetic Construct
ggcctcttaagttctaggctgcat

SEQ ID NO: 43661 - DNA, 21 bp, Artificial Sequence
  Synthetic Construct
aagggccttagccatcaccta

SEQ ID NO: 43662 - DNA, 24 bp, Artificial Sequence
  Synthetic Construct
ggacgtgacctcagtcaagctcaa

SEQ ID NO: 43663 - DNA, 20 bp, Artificial Sequence
  Synthetic Construct
agcttgctagcctgccttca

SEQ ID NO: 43664 - DNA, 20 bp, Artificial Sequence
  Synthetic Construct
aatcccagcgtgtgctcatc

SEQ ID NO: 43665 - DNA, 24 bp, Artificial Sequence
  Synthetic Construct
tcacaagacccaaactgcctattc

SEQ ID NO: 43666 - DNA, 20 bp, Artificial Sequence
  Synthetic Construct
taggggccacaggctcttga

SEQ ID NO: 43667 - DNA, 22 bp, Artificial Sequence
  Synthetic Construct
ccgggagaacgtggcagaattt

SEQ ID NO: 43668 - DNA, 20 bp, Artificial Sequence
  Synthetic Construct
gtttggactgagccctgtga

SEQ ID NO: 43669 - DNA, 21 bp, Artificial Sequence
  Synthetic Construct
aagagccaccagcctctggaa

SEQ ID NO: 43670 - DNA, 22 bp, Artificial Sequence
  Synthetic Construct
gtctctgcagccataccaccaa

SEQ ID NO: 43671 - DNA, 21 bp, Artificial Sequence
  Synthetic Construct
gtgttttcagggcagcgtgtt

SEQ ID NO: 43672 - DNA, 21 bp, Artificial Sequence
  Synthetic Construct
cgctggttcccagtgaccttt

SEQ ID NO: 43673 - DNA, 21 bp, Artificial Sequence
  Synthetic Construct
acacaccccatctctgctgaa

SEQ ID NO: 43674 - DNA, 25 bp, Artificial Sequence
  Synthetic Construct
ggctttgagctaactgttcccagat

SEQ ID NO: 43675 - DNA, 25 bp, Artificial Sequence
  Synthetic Construct
cacacactccttgctaatggggatt

SEQ ID NO: 43676 - DNA, 18 bp, Artificial Sequence
  Synthetic Construct
tgcagggctgggaacaca

SEQ ID NO: 43677 - DNA, 23 bp, Artificial Sequence
  Synthetic Construct
cctagagaccatgaccctgttgt

SEQ ID NO: 43678 - DNA, 23 bp, Artificial Sequence
  Synthetic Construct
cgtgcatccgtaaaacaccaatg

SEQ ID NO: 43679 - DNA, 20 bp, Artificial Sequence
  Synthetic Construct
caggtgggctgcatgaaaca

SEQ ID NO: 43680 - DNA, 26 bp, Artificial Sequence
  Synthetic Construct
cctggggtctattctcaacccagtag

SEQ ID NO: 43681 - DNA, 21 bp, Artificial Sequence
  Synthetic Construct
tgaacccctgggcatcttaca

SEQ ID NO: 43682 - DNA, 22 bp, Artificial Sequence
  Synthetic Construct
gttgacctcagccttcatgctt

SEQ ID NO: 43683 - DNA, 21 bp, Artificial Sequence
  Synthetic Construct
ggcagctcatggatggaaagt

SEQ ID NO: 43684 - DNA, 22 bp, Artificial Sequence
  Synthetic Construct
gactccaggggcttgttactca

SEQ ID NO: 43685 - DNA, 24 bp, Artificial Sequence
  Synthetic Construct
gcttcctaaaatgtctgggctctt

SEQ ID NO: 43686 - DNA, 22 bp, Artificial Sequence
  Synthetic Construct
gggtgcgacacaccacataaca

SEQ ID NO: 43687 - DNA, 23 bp, Artificial Sequence
  Synthetic Construct
gctgggaacactgtgcaacatac

SEQ ID NO: 43688 - DNA, 19 bp, Artificial Sequence
  Synthetic Construct
ggatgggacgcctgactct

SEQ ID NO: 43689 - DNA, 21 bp, Artificial Sequence
  Synthetic Construct
tctcgtgcagttcgcctctac

SEQ ID NO: 43690 - DNA, 21 bp, Artificial Sequence
  Synthetic Construct
gcagatgtctgggcttgtttc

SEQ ID NO: 43691 - DNA, 24 bp, Artificial Sequence
  Synthetic Construct
cagagtgttcagaacccagttagt

SEQ ID NO: 43692 - DNA, 19 bp, Artificial Sequence
  Synthetic Construct
atgtcagccacccgtccaa

SEQ ID NO: 43693 - DNA, 23 bp, Artificial Sequence
  Synthetic Construct
cacctacaaatggcctcgtcaca

SEQ ID NO: 43694 - DNA, 20 bp, Artificial Sequence
  Synthetic Construct
tcccttgcaacgtgctcaca

SEQ ID NO: 43695 - DNA, 18 bp, Artificial Sequence
  Synthetic Construct
acacacggccagctccat

SEQ ID NO: 43696 - DNA, 26 bp, Artificial Sequence
  Synthetic Construct
ggaaccaactgatggactcaaagaca

SEQ ID NO: 43697 - DNA, 25 bp, Artificial Sequence
  Synthetic Construct
gcctcctattgagagtcaaggtcta

SEQ ID NO: 43698 - DNA, 21 bp, Artificial Sequence
  Synthetic Construct
cggtccttcaggagggctttg

SEQ ID NO: 43699 - DNA, 23 bp, Artificial Sequence
  Synthetic Construct
cctgcccacatgcctttactttc

SEQ ID NO: 43700 - DNA, 23 bp, Artificial Sequence
  Synthetic Construct
cccgcttcatagaccaggaaatg

SEQ ID NO: 43701 - DNA, 21 bp, Artificial Sequence
  Synthetic Construct
gccaacgaaccgaacctaaac

SEQ ID NO: 43702 - DNA, 21 bp, Artificial Sequence
  Synthetic Construct
ccttcccaaccaagagcaaga

SEQ ID NO: 43703 - DNA, 24 bp, Artificial Sequence
  Synthetic Construct
ggctgtgcctagagataggagcat

SEQ ID NO: 43704 - DNA, 25 bp, Artificial Sequence
  Synthetic Construct
gcaggattaactgtcccctggcata

SEQ ID NO: 43705 - DNA, 21 bp, Artificial Sequence
  Synthetic Construct
gtgtctgtcccttcaccacat

SEQ ID NO: 43706 - DNA, 24 bp, Artificial Sequence
  Synthetic Construct
ggccactacactgtgggttaggat

SEQ ID NO: 43707 - DNA, 22 bp, Artificial Sequence
  Synthetic Construct
gggcagagaatcacgactcctt

SEQ ID NO: 43708 - DNA, 23 bp, Artificial Sequence
  Synthetic Construct
ctcctgaagcgcaaattgtcagt

SEQ ID NO: 43709 - DNA, 20 bp, Artificial Sequence
  Synthetic Construct
acggctgccaacctaaggaa

SEQ ID NO: 43710 - DNA, 20 bp, Artificial Sequence
  Synthetic Construct
tttggggttcctgcctcact

SEQ ID NO: 43711 - DNA, 20 bp, Artificial Sequence
  Synthetic Construct
cggttgcccaatctctcctt

SEQ ID NO: 43712 - DNA, 21 bp, Artificial Sequence
  Synthetic Construct
actccgatgctgggagaccat

SEQ ID NO: 43713 - DNA, 23 bp, Artificial Sequence
  Synthetic Construct
ctttgggaaccccaagtcttttc

SEQ ID NO: 43714 - DNA, 19 bp, Artificial Sequence
  Synthetic Construct
tggagagtggctcccttgt

SEQ ID NO: 43715 - DNA, 21 bp, Artificial Sequence
  Synthetic Construct
gggtcgcttgtgataggacat

SEQ ID NO: 43716 - DNA, 21 bp, Artificial Sequence
  Synthetic Construct
acctcttccacttggctctca

SEQ ID NO: 43717 - DNA, 22 bp, Artificial Sequence
  Synthetic Construct
gcacgtttccacactccccatt

SEQ ID NO: 43718 - DNA, 20 bp, Artificial Sequence
  Synthetic Construct
ccagcagcagaccacttcaa

SEQ ID NO: 43719 - DNA, 20 bp, Artificial Sequence
  Synthetic Construct
ggaatggcgttggtgactgt

SEQ ID NO: 43720 - DNA, 20 bp, Artificial Sequence
  Synthetic Construct
ccacgctgtgtaagccttga

SEQ ID NO: 43721 - DNA, 24 bp, Artificial Sequence
  Synthetic Construct
gaaagccaccaagaaaccgttatg

SEQ ID NO: 43722 - DNA, 19 bp, Artificial Sequence
  Synthetic Construct
agcccgttggtcccacatt

SEQ ID NO: 43723 - DNA, 25 bp, Artificial Sequence
  Synthetic Construct
cctctttctgtagtgagagcagaga

SEQ ID NO: 43724 - DNA, 22 bp, Artificial Sequence
  Synthetic Construct
ctgtggcactggaaggcatatc

SEQ ID NO: 43725 - DNA, 20 bp, Artificial Sequence
  Synthetic Construct
tccacgggatgacgcagatg

SEQ ID NO: 43726 - DNA, 23 bp, Artificial Sequence
  Synthetic Construct
accggtctgtccttcctccaatc

SEQ ID NO: 43727 - DNA, 22 bp, Artificial Sequence
  Synthetic Construct
ggatctcaccatccaggaggaa

SEQ ID NO: 43728 - DNA, 22 bp, Artificial Sequence
  Synthetic Construct
cccatcagcactggggtttgta

SEQ ID NO: 43729 - DNA, 22 bp, Artificial Sequence
  Synthetic Construct
actcttcccttgctccacctaa

SEQ ID NO: 43730 - DNA, 27 bp, Artificial Sequence
  Synthetic Construct
ggctttctgttgtggtcttatggaaac

SEQ ID NO: 43731 - DNA, 21 bp, Artificial Sequence
  Synthetic Construct
aggaccgggcacctcatttgt

SEQ ID NO: 43732 - DNA, 21 bp, Artificial Sequence
  Synthetic Construct
actgtctgaggaaggccagat

SEQ ID NO: 43733 - DNA, 24 bp, Artificial Sequence
  Synthetic Construct
ggcttcctcggaaaaagacagttg

SEQ ID NO: 43734 - DNA, 20 bp, Artificial Sequence
  Synthetic Construct
atcttgccttctgccagcat

SEQ ID NO: 43735 - DNA, 20 bp, Artificial Sequence
  Synthetic Construct
tgtcccagcaaagggtgcta

SEQ ID NO: 43736 - DNA, 23 bp, Artificial Sequence
  Synthetic Construct
tcatccacctatccacctccaat

SEQ ID NO: 43737 - DNA, 24 bp, Artificial Sequence
  Synthetic Construct
gggttcatgctacaggtggccttt

SEQ ID NO: 43738 - DNA, 20 bp, Artificial Sequence
  Synthetic Construct
agcccagccctcccctctta

SEQ ID NO: 43739 - DNA, 22 bp, Artificial Sequence
  Synthetic Construct
ccctcatggctccattccaagt

SEQ ID NO: 43740 - DNA, 24 bp, Artificial Sequence
  Synthetic Construct
tgtttgcaattctgtgaccctaca

SEQ ID NO: 43741 - DNA, 22 bp, Artificial Sequence
  Synthetic Construct
ggaggacattaccagggcagaa

SEQ ID NO: 43742 - DNA, 22 bp, Artificial Sequence
  Synthetic Construct
gcaaacaacacactcagcagat

SEQ ID NO: 43743 - DNA, 20 bp, Artificial Sequence
  Synthetic Construct
tgacgtgagaggggtacaca

SEQ ID NO: 43744 - DNA, 21 bp, Artificial Sequence
  Synthetic Construct
acttcctgtgggccagtgttg

SEQ ID NO: 43745 - DNA, 19 bp, Artificial Sequence
  Synthetic Construct
agacaccacgggcctcctt

SEQ ID NO: 43746 - DNA, 19 bp, Artificial Sequence
  Synthetic Construct
agggaacgaggcaggactt

SEQ ID NO: 43747 - DNA, 24 bp, Artificial Sequence
  Synthetic Construct
ctttggaatctgtgcttcctggat

SEQ ID NO: 43748 - DNA, 21 bp, Artificial Sequence
  Synthetic Construct
acactgcaagtccagcctact

SEQ ID NO: 43749 - DNA, 24 bp, Artificial Sequence
  Synthetic Construct
gatttcgtaccacctttcctctgt

SEQ ID NO: 43750 - DNA, 19 bp, Artificial Sequence
  Synthetic Construct
tgcagctggggtgttctca

SEQ ID NO: 43751 - DNA, 19 bp, Artificial Sequence
  Synthetic Construct
cacctcagcagccatgctt

SEQ ID NO: 43752 - DNA, 20 bp, Artificial Sequence
  Synthetic Construct
tctcagaacctcccgccata

SEQ ID NO: 43753 - DNA, 23 bp, Artificial Sequence
  Synthetic Construct
ggcagagaagcatgcaagggaaa

SEQ ID NO: 43754 - DNA, 22 bp, Artificial Sequence
  Synthetic Construct
ggctgccttccacctatggttt

SEQ ID NO: 43755 - DNA, 24 bp, Artificial Sequence
  Synthetic Construct
cattgggaccaagtgcttatcatc

SEQ ID NO: 43756 - DNA, 24 bp, Artificial Sequence
  Synthetic Construct
ctgttgagatcagagggagtggat

SEQ ID NO: 43757 - DNA, 21 bp, Artificial Sequence
  Synthetic Construct
aggccacccgtaatcgtgtct

SEQ ID NO: 43758 - DNA, 22 bp, Artificial Sequence
  Synthetic Construct
gcacaatggcagaatgcagtta

SEQ ID NO: 43759 - DNA, 20 bp, Artificial Sequence
  Synthetic Construct
agccagatggcggctcttta

SEQ ID NO: 43760 - DNA, 25 bp, Artificial Sequence
  Synthetic Construct
tgtgctgatactcagtttgacttgt

SEQ ID NO: 43761 - DNA, 27 bp, Artificial Sequence
  Synthetic Construct
cctcctaagaggagtcttcagtggttt

SEQ ID NO: 43762 - DNA, 25 bp, Artificial Sequence
  Synthetic Construct
gcaaagagcccttttgagaggtaac

SEQ ID NO: 43763 - DNA, 21 bp, Artificial Sequence
  Synthetic Construct
ggcctgttccaccaaaacttg

SEQ ID NO: 43764 - DNA, 20 bp, Artificial Sequence
  Synthetic Construct
ggcataaaggcggggcttct

SEQ ID NO: 43765 - DNA, 20 bp, Artificial Sequence
  Synthetic Construct
ctgcatggagacgctgatct

SEQ ID NO: 43766 - DNA, 24 bp, Artificial Sequence
  Synthetic Construct
gcagaaatcttgcagtgggataag

SEQ ID NO: 43767 - DNA, 22 bp, Artificial Sequence
  Synthetic Construct
tgagaggagcagtgggatctga

SEQ ID NO: 43768 - DNA, 27 bp, Artificial Sequence
  Synthetic Construct
gcaggaagtctccatctatgaggaaca

SEQ ID NO: 43769 - DNA, 23 bp, Artificial Sequence
  Synthetic Construct
tgaagaggattcagcccagtttc

SEQ ID NO: 43770 - DNA, 29 bp, Artificial Sequence
  Synthetic Construct
ctcagaagttttaccgaggactatagaag

SEQ ID NO: 43771 - DNA, 21 bp, Artificial Sequence
  Synthetic Construct
ggccaagaaggggaatgaaca

SEQ ID NO: 43772 - DNA, 22 bp, Artificial Sequence
  Synthetic Construct
accccacctccattctccttag

SEQ ID NO: 43773 - DNA, 23 bp, Artificial Sequence
  Synthetic Construct
tggtggcttttggttgagttaca

SEQ ID NO: 43774 - DNA, 21 bp, Artificial Sequence
  Synthetic Construct
cggtaggtgaagggactgtgt

SEQ ID NO: 43775 - DNA, 20 bp, Artificial Sequence
  Synthetic Construct
ggtgaggctttctgctccat

SEQ ID NO: 43776 - DNA, 19 bp, Artificial Sequence
  Synthetic Construct
caagcccctctgggagtgt

SEQ ID NO: 43777 - DNA, 19 bp, Artificial Sequence
  Synthetic Construct
atgcgggagaggggagaag

SEQ ID NO: 43778 - DNA, 22 bp, Artificial Sequence
  Synthetic Construct
ctgaactctgccagcccaagat

SEQ ID NO: 43779 - DNA, 18 bp, Artificial Sequence
  Synthetic Construct
tgccaccacgccagcatt

SEQ ID NO: 43780 - DNA, 22 bp, Artificial Sequence
  Synthetic Construct
ctgggagtgggaggaatggaaa

SEQ ID NO: 43781 - DNA, 24 bp, Artificial Sequence
  Synthetic Construct
tgctattgcctttgaaccacattc

SEQ ID NO: 43782 - DNA, 27 bp, Artificial Sequence
  Synthetic Construct
cccctgtagccacttttgagtggaaaa

SEQ ID NO: 43783 - DNA, 24 bp, Artificial Sequence
  Synthetic Construct
ggagttactgctgattgcctgaca

SEQ ID NO: 43784 - DNA, 21 bp, Artificial Sequence
  Synthetic Construct
acactgggaaccagggactga

SEQ ID NO: 43785 - DNA, 20 bp, Artificial Sequence
  Synthetic Construct
tggggcagcatctcaacact

SEQ ID NO: 43786 - DNA, 22 bp, Artificial Sequence
  Synthetic Construct
gcctggttttctgcgtgtggaa

SEQ ID NO: 43787 - DNA, 19 bp, Artificial Sequence
  Synthetic Construct
aagcggctgcaggctggaa

SEQ ID NO: 43788 - DNA, 22 bp, Artificial Sequence
  Synthetic Construct
ctcttcctaccagcacaaccat

SEQ ID NO: 43789 - DNA, 20 bp, Artificial Sequence
  Synthetic Construct
ccacctctgctgcaatggaa

SEQ ID NO: 43790 - DNA, 19 bp, Artificial Sequence
  Synthetic Construct
acagcagaggcgggacaca

SEQ ID NO: 43791 - DNA, 23 bp, Artificial Sequence
  Synthetic Construct
tgatgtaggaaccaagggtcagt

SEQ ID NO: 43792 - DNA, 19 bp, Artificial Sequence
  Synthetic Construct
agcgctctccagccttgaa

SEQ ID NO: 43793 - DNA, 21 bp, Artificial Sequence
  Synthetic Construct
agagggcctgggttctaggta

SEQ ID NO: 43794 - DNA, 21 bp, Artificial Sequence
  Synthetic Construct
aaggccagttagccccagact

SEQ ID NO: 43795 - DNA, 22 bp, Artificial Sequence
  Synthetic Construct
accagttggccatcctagagaa

SEQ ID NO: 43796 - DNA, 23 bp, Artificial Sequence
  Synthetic Construct
ctccatttgcactttggaactgt

SEQ ID NO: 43797 - DNA, 25 bp, Artificial Sequence
  Synthetic Construct
caggcacaatttaacccatcacact

SEQ ID NO: 43798 - DNA, 21 bp, Artificial Sequence
  Synthetic Construct
gctcgccctacactcttgctt

SEQ ID NO: 43799 - DNA, 22 bp, Artificial Sequence
  Synthetic Construct
tcttccaaacacctcgcttcaa

SEQ ID NO: 43800 - DNA, 23 bp, Artificial Sequence
  Synthetic Construct
tgtagtccacaggctgcaaatac

SEQ ID NO: 43801 - DNA, 20 bp, Artificial Sequence
  Synthetic Construct
agactgccagggtggagtga

SEQ ID NO: 43802 - DNA, 23 bp, Artificial Sequence
  Synthetic Construct
tgagtttcttctctgcaggtgtt

SEQ ID NO: 43803 - DNA, 21 bp, Artificial Sequence
  Synthetic Construct
tttgccccagaggctcacaca

SEQ ID NO: 43804 - DNA, 22 bp, Artificial Sequence
  Synthetic Construct
cttgctcatcctccacttgtct

SEQ ID NO: 43805 - DNA, 22 bp, Artificial Sequence
  Synthetic Construct
ctgaaaagtctgcagcccaaaa

SEQ ID NO: 43806 - DNA, 27 bp, Artificial Sequence
  Synthetic Construct
cctcttaatatgacccagcgattgtgt

SEQ ID NO: 43807 - DNA, 26 bp, Artificial Sequence
  Synthetic Construct
ggtttctcctccctagaaggaactgt

SEQ ID NO: 43808 - DNA, 20 bp, Artificial Sequence
  Synthetic Construct
ctccattgccagcagctgaa

SEQ ID NO: 43809 - DNA, 20 bp, Artificial Sequence
  Synthetic Construct
tccttgggacctggggtcat

SEQ ID NO: 43810 - DNA, 24 bp, Artificial Sequence
  Synthetic Construct
tcctccatggttagcttggtttac

SEQ ID NO: 43811 - DNA, 19 bp, Artificial Sequence
  Synthetic Construct
agccatggccacagtctct

SEQ ID NO: 43812 - DNA, 25 bp, Artificial Sequence
  Synthetic Construct
acacaaacaacagtccttctcagat

SEQ ID NO: 43813 - DNA, 19 bp, Artificial Sequence
  Synthetic Construct
cagggttccagccctccat

SEQ ID NO: 43814 - DNA, 23 bp, Artificial Sequence
  Synthetic Construct
ggtccacttccttatagctgctt

SEQ ID NO: 43815 - DNA, 25 bp, Artificial Sequence
  Synthetic Construct
ccaagtgtgcaaaaagaaaggctat

SEQ ID NO: 43816 - DNA, 24 bp, Artificial Sequence
  Synthetic Construct
gcactatgagaaggggagcagtca

SEQ ID NO: 43817 - DNA, 22 bp, Artificial Sequence
  Synthetic Construct
agggaatctagccctggggaaa

SEQ ID NO: 43818 - DNA, 23 bp, Artificial Sequence
  Synthetic Construct
ccggggattaagcaacagcaagt

SEQ ID NO: 43819 - DNA, 27 bp, Artificial Sequence
  Synthetic Construct
ccctgatgaaaacacaactgtcaggat

SEQ ID NO: 43820 - DNA, 19 bp, Artificial Sequence
  Synthetic Construct
taccccgtagcgtgagtgt

SEQ ID NO: 43821 - DNA, 19 bp, Artificial Sequence
  Synthetic Construct
accatgcccagccatgaac

SEQ ID NO: 43822 - DNA, 27 bp, Artificial Sequence
  Synthetic Construct
cctctcttgccacatgatctctgtatg

SEQ ID NO: 43823 - DNA, 27 bp, Artificial Sequence
  Synthetic Construct
gggtatgggataatggtggaaggaaca

SEQ ID NO: 43824 - DNA, 22 bp, Artificial Sequence
  Synthetic Construct
catggtcatgcaaagcatccat

SEQ ID NO: 43825 - DNA, 27 bp, Artificial Sequence
  Synthetic Construct
ctctcctttggttttcgatctgctatg

SEQ ID NO: 43826 - DNA, 23 bp, Artificial Sequence
  Synthetic Construct
cgtattctgtagcacagcactga

SEQ ID NO: 43827 - DNA, 23 bp, Artificial Sequence
  Synthetic Construct
agctggaaacctagaaacaccaa

SEQ ID NO: 43828 - DNA, 18 bp, Artificial Sequence
  Synthetic Construct
tgccacccagcactgtga

SEQ ID NO: 43829 - DNA, 22 bp, Artificial Sequence
  Synthetic Construct
cctgctggagacccttcaatct

SEQ ID NO: 43830 - DNA, 20 bp, Artificial Sequence
  Synthetic Construct
aggctgtgctgggccccata

SEQ ID NO: 43831 - DNA, 24 bp, Artificial Sequence
  Synthetic Construct
cagctggacataccaagaccttct

SEQ ID NO: 43832 - DNA, 26 bp, Artificial Sequence
  Synthetic Construct
gtctggtattacactggaggatcaca

SEQ ID NO: 43833 - DNA, 24 bp, Artificial Sequence
  Synthetic Construct
actagcaagtcggaaaacttggaa

SEQ ID NO: 43834 - DNA, 19 bp, Artificial Sequence
  Synthetic Construct
accctgaactcccggcttt

SEQ ID NO: 43835 - DNA, 20 bp, Artificial Sequence
  Synthetic Construct
tgacattgcacagcgtctca

SEQ ID NO: 43836 - DNA, 18 bp, Artificial Sequence
  Synthetic Construct
aaggctgggccactgtgt

SEQ ID NO: 43837 - DNA, 21 bp, Artificial Sequence
  Synthetic Construct
gtgcatgcatgtggtgaggaa

SEQ ID NO: 43838 - DNA, 22 bp, Artificial Sequence
  Synthetic Construct
cagacgttgggcatcacctaga

SEQ ID NO: 43839 - DNA, 20 bp, Artificial Sequence
  Synthetic Construct
ggttggcacacctgcattga

SEQ ID NO: 43840 - DNA, 20 bp, Artificial Sequence
  Synthetic Construct
gccctccgtggaaaggctta

SEQ ID NO: 43841 - DNA, 24 bp, Artificial Sequence
  Synthetic Construct
gagatcctcaggcaccaaagatgt

SEQ ID NO: 43842 - DNA, 22 bp, Artificial Sequence
  Synthetic Construct
aggtgcctctcgtcctcctaac

SEQ ID NO: 43843 - DNA, 22 bp, Artificial Sequence
  Synthetic Construct
cctgaccttggtgctgagttct

SEQ ID NO: 43844 - DNA, 21 bp, Artificial Sequence
  Synthetic Construct
cccctgctatgtgccatcttc

SEQ ID NO: 43845 - DNA, 20 bp, Artificial Sequence
  Synthetic Construct
cttgtgcaaaggccctgcta

SEQ ID NO: 43846 - DNA, 20 bp, Artificial Sequence
  Synthetic Construct
atgccaccggagtgagaaga

SEQ ID NO: 43847 - DNA, 20 bp, Artificial Sequence
  Synthetic Construct
cccaaacatgggtgggctaa

SEQ ID NO: 43848 - DNA, 20 bp, Artificial Sequence
  Synthetic Construct
acctggcacaccccttcaaa

SEQ ID NO: 43849 - DNA, 24 bp, Artificial Sequence
  Synthetic Construct
agtcgttaaatcttcagggcttct

SEQ ID NO: 43850 - DNA, 25 bp, Artificial Sequence
  Synthetic Construct
ctcttaaccactaccctccactact

SEQ ID NO: 43851 - DNA, 22 bp, Artificial Sequence
  Synthetic Construct
ggcagcagaggaccatttacaa

SEQ ID NO: 43852 - DNA, 25 bp, Artificial Sequence
  Synthetic Construct
gcagtgtgtaaaaagccttcagaac

SEQ ID NO: 43853 - DNA, 19 bp, Artificial Sequence
  Synthetic Construct
cagagggtgggagccagtt

SEQ ID NO: 43854 - DNA, 25 bp, Artificial Sequence
  Synthetic Construct
cagatggccactagaactcttcgta

SEQ ID NO: 43855 - DNA, 21 bp, Artificial Sequence
  Synthetic Construct
ggccctggtgtcattttccaa

SEQ ID NO: 43856 - DNA, 22 bp, Artificial Sequence
  Synthetic Construct
gggaagtaggagtggcagtaac

SEQ ID NO: 43857 - DNA, 24 bp, Artificial Sequence
  Synthetic Construct
ctcattccattgcttgctgtggtt

SEQ ID NO: 43858 - DNA, 21 bp, Artificial Sequence
  Synthetic Construct
tgatgcctcttccaccccttt

SEQ ID NO: 43859 - DNA, 20 bp, Artificial Sequence
  Synthetic Construct
tgggcaggaagtcccagaat

SEQ ID NO: 43860 - DNA, 22 bp, Artificial Sequence
  Synthetic Construct
gcatcctctgggaagggttaca

SEQ ID NO: 43861 - DNA, 19 bp, Artificial Sequence
  Synthetic Construct
tctggcaccctgagagctt

SEQ ID NO: 43862 - DNA, 25 bp, Artificial Sequence
  Synthetic Construct
cctctgcttttctagtttccaccaa

SEQ ID NO: 43863 - DNA, 24 bp, Artificial Sequence
  Synthetic Construct
cctggtcacattaggctgttcact

SEQ ID NO: 43864 - DNA, 22 bp, Artificial Sequence
  Synthetic Construct
gcttggcctgcagtcacttaga

SEQ ID NO: 43865 - DNA, 22 bp, Artificial Sequence
  Synthetic Construct
tccttgtggagcagggctaact

SEQ ID NO: 43866 - DNA, 22 bp, Artificial Sequence
  Synthetic Construct
aggaataggggccgtgctgtta

SEQ ID NO: 43867 - DNA, 23 bp, Artificial Sequence
  Synthetic Construct
cccctggtctgcaatcctgaatc

SEQ ID NO: 43868 - DNA, 20 bp, Artificial Sequence
  Synthetic Construct
tgcagagaggcttgggatga

SEQ ID NO: 43869 - DNA, 21 bp, Artificial Sequence
  Synthetic Construct
gcaaggatggggcactacact

SEQ ID NO: 43870 - DNA, 24 bp, Artificial Sequence
  Synthetic Construct
gcaacatcacagacaaacgtggta

SEQ ID NO: 43871 - DNA, 23 bp, Artificial Sequence
  Synthetic Construct
gcagaaaccaacttctgggctta

SEQ ID NO: 43872 - DNA, 22 bp, Artificial Sequence
  Synthetic Construct
tcctccccataacggtggctat

SEQ ID NO: 43873 - DNA, 22 bp, Artificial Sequence
  Synthetic Construct
cctgtcttgggagctgaaccaa

SEQ ID NO: 43874 - DNA, 22 bp, Artificial Sequence
  Synthetic Construct
ctgtgtggctgggatcaagttc

SEQ ID NO: 43875 - DNA, 21 bp, Artificial Sequence
  Synthetic Construct
gcttggcttgctcttgtttca

SEQ ID NO: 43876 - DNA, 20 bp, Artificial Sequence
  Synthetic Construct
gcttcagatccagccacagt

SEQ ID NO: 43877 - DNA, 26 bp, Artificial Sequence
  Synthetic Construct
cgagggatcataggttcttcattttg

SEQ ID NO: 43878 - DNA, 21 bp, Artificial Sequence
  Synthetic Construct
ggcacctggctgagtccattt

SEQ ID NO: 43879 - DNA, 21 bp, Artificial Sequence
  Synthetic Construct
gagagagaaggggctgtctca

SEQ ID NO: 43880 - DNA, 22 bp, Artificial Sequence
  Synthetic Construct
tccaccaactcacccactggaa

SEQ ID NO: 43881 - DNA, 26 bp, Artificial Sequence
  Synthetic Construct
gtgggaagtaagaatcttgcccaaac

SEQ ID NO: 43882 - DNA, 21 bp, Artificial Sequence
  Synthetic Construct
tttctggccccagtgcctctt

SEQ ID NO: 43883 - DNA, 24 bp, Artificial Sequence
  Synthetic Construct
tccttgggatcaacacatgtgaaa

SEQ ID NO: 43884 - DNA, 22 bp, Artificial Sequence
  Synthetic Construct
accaggactgggttctctcttc

SEQ ID NO: 43885 - DNA, 24 bp, Artificial Sequence
  Synthetic Construct
caagtaccatccctgccttactac

SEQ ID NO: 43886 - DNA, 20 bp, Artificial Sequence
  Synthetic Construct
agcagggacaaaggctcaga

SEQ ID NO: 43887 - DNA, 20 bp, Artificial Sequence
  Synthetic Construct
cctgacacccaggaccacaa

SEQ ID NO: 43888 - DNA, 21 bp, Artificial Sequence
  Synthetic Construct
ggttgatggctgtggggaaca

SEQ ID NO: 43889 - DNA, 23 bp, Artificial Sequence
  Synthetic Construct
taggtagcctggggtctgtctct

SEQ ID NO: 43890 - DNA, 22 bp, Artificial Sequence
  Synthetic Construct
gggattacagcctctccacctt

SEQ ID NO: 43891 - DNA, 23 bp, Artificial Sequence
  Synthetic Construct
cagggcagttagactcctgcaat

SEQ ID NO: 43892 - DNA, 23 bp, Artificial Sequence
  Synthetic Construct
agtccagacctctttccaagaca

SEQ ID NO: 43893 - DNA, 24 bp, Artificial Sequence
  Synthetic Construct
ccagtctctttcctttcaccgtta

SEQ ID NO: 43894 - DNA, 23 bp, Artificial Sequence
  Synthetic Construct
ccactgttcaagtgagccctgta

SEQ ID NO: 43895 - DNA, 20 bp, Artificial Sequence
  Synthetic Construct
tgcacagcctggatggttct

SEQ ID NO: 43896 - DNA, 19 bp, Artificial Sequence
  Synthetic Construct
gccatgccttgcacacaga

SEQ ID NO: 43897 - DNA, 24 bp, Artificial Sequence
  Synthetic Construct
gggaccttgacactgactctcttc

SEQ ID NO: 43898 - DNA, 21 bp, Artificial Sequence
  Synthetic Construct
acatccgcccctcttctcctt

SEQ ID NO: 43899 - DNA, 22 bp, Artificial Sequence
  Synthetic Construct
tggtggaaagaggtggcaatag

SEQ ID NO: 43900 - DNA, 22 bp, Artificial Sequence
  Synthetic Construct
agctagtgccctcttgcacaac

SEQ ID NO: 43901 - DNA, 20 bp, Artificial Sequence
  Synthetic Construct
tccccatgccaccctgcata

SEQ ID NO: 43902 - DNA, 28 bp, Artificial Sequence
  Synthetic Construct
ccactggatagaagaagttccccacata

SEQ ID NO: 43903 - DNA, 22 bp, Artificial Sequence
  Synthetic Construct
gctggtttgcggatggatgtct

SEQ ID NO: 43904 - DNA, 20 bp, Artificial Sequence
  Synthetic Construct
atgaccaggtcggagcgttt

SEQ ID NO: 43905 - DNA, 22 bp, Artificial Sequence
  Synthetic Construct
agtccggaatatcagccccata

SEQ ID NO: 43906 - DNA, 20 bp, Artificial Sequence
  Synthetic Construct
gcgtctgaccctgtgtggtt

SEQ ID NO: 43907 - DNA, 21 bp, Artificial Sequence
  Synthetic Construct
tcctcccttctggctgtctac

SEQ ID NO: 43908 - DNA, 22 bp, Artificial Sequence
  Synthetic Construct
accctgactttggagggacaca

SEQ ID NO: 43909 - DNA, 20 bp, Artificial Sequence
  Synthetic Construct
ggtagcctggggcaagtttt

SEQ ID NO: 43910 - DNA, 26 bp, Artificial Sequence
  Synthetic Construct
gaatctaacaagtcacccagttccta

SEQ ID NO: 43911 - DNA, 22 bp, Artificial Sequence
  Synthetic Construct
cccgtagtcacaaacccctaca

SEQ ID NO: 43912 - DNA, 24 bp, Artificial Sequence
  Synthetic Construct
gcctggcttaaaataagtgcttga

SEQ ID NO: 43913 - DNA, 22 bp, Artificial Sequence
  Synthetic Construct
agcaaccatgttaggtgccatt

SEQ ID NO: 43914 - DNA, 22 bp, Artificial Sequence
  Synthetic Construct
ttttgtgagcccctggttagtt

SEQ ID NO: 43915 - DNA, 27 bp, Artificial Sequence
  Synthetic Construct
gggcacctttactcatcctaccagata

SEQ ID NO: 43916 - DNA, 21 bp, Artificial Sequence
  Synthetic Construct
tagccaccctgcagaccttgt

SEQ ID NO: 43917 - DNA, 21 bp, Artificial Sequence
  Synthetic Construct
actggccagaagtgcctattc

SEQ ID NO: 43918 - DNA, 23 bp, Artificial Sequence
  Synthetic Construct
cgttttcttgcctccagttggtt

SEQ ID NO: 43919 - DNA, 20 bp, Artificial Sequence
  Synthetic Construct
ctacaggcacacgctaccat

SEQ ID NO: 43920 - DNA, 20 bp, Artificial Sequence
  Synthetic Construct
gcccaacgctcagacagaca

SEQ ID NO: 43921 - DNA, 23 bp, Artificial Sequence
  Synthetic Construct
gagggttagtggactctggtcta

SEQ ID NO: 43922 - DNA, 25 bp, Artificial Sequence
  Synthetic Construct
acaacagagttagcagttcttcaca

SEQ ID NO: 43923 - DNA, 20 bp, Artificial Sequence
  Synthetic Construct
ccccagatgccaagaacctt

SEQ ID NO: 43924 - DNA, 20 bp, Artificial Sequence
  Synthetic Construct
aaggcacgtatggcctcaac

SEQ ID NO: 43925 - DNA, 25 bp, Artificial Sequence
  Synthetic Construct
caaccagaaagcactcattcctaac

SEQ ID NO: 43926 - DNA, 22 bp, Artificial Sequence
  Synthetic Construct
gcacttggcaggcacctagtat

SEQ ID NO: 43927 - DNA, 23 bp, Artificial Sequence
  Synthetic Construct
ggtgaagagccaatcaggccata

SEQ ID NO: 43928 - DNA, 20 bp, Artificial Sequence
  Synthetic Construct
atccccaaagtggccacaac

SEQ ID NO: 43929 - DNA, 19 bp, Artificial Sequence
  Synthetic Construct
ggcgcacttcatgctgcaa

SEQ ID NO: 43930 - DNA, 26 bp, Artificial Sequence
  Synthetic Construct
ccatcgtgactatctcatgggtgatg

SEQ ID NO: 43931 - DNA, 23 bp, Artificial Sequence
  Synthetic Construct
gggaggtcctgttgctaatgttg

SEQ ID NO: 43932 - DNA, 28 bp, Artificial Sequence
  Synthetic Construct
ggactatgttctgtgtcctccttttgaa

SEQ ID NO: 43933 - DNA, 20 bp, Artificial Sequence
  Synthetic Construct
tccactgggaggctgggaaa

SEQ ID NO: 43934 - DNA, 21 bp, Artificial Sequence
  Synthetic Construct
ccagtttggtgacggggctta

SEQ ID NO: 43935 - DNA, 21 bp, Artificial Sequence
  Synthetic Construct
tggctccagtcttcccagcta

SEQ ID NO: 43936 - DNA, 19 bp, Artificial Sequence
  Synthetic Construct
actcgagcccgctgctgtt

SEQ ID NO: 43937 - DNA, 24 bp, Artificial Sequence
  Synthetic Construct
cccttgttgtccttcctcgtctgt

SEQ ID NO: 43938 - DNA, 20 bp, Artificial Sequence
  Synthetic Construct
gccaactctcagccaccaaa

SEQ ID NO: 43939 - DNA, 22 bp, Artificial Sequence
  Synthetic Construct
gggcgcaagtaccggtataaca

SEQ ID NO: 43940 - DNA, 24 bp, Artificial Sequence
  Synthetic Construct
aggcagtctctcagtgtaaagaag

SEQ ID NO: 43941 - DNA, 27 bp, Artificial Sequence
  Synthetic Construct
cccttggttcccatactgtaaacaaca

SEQ ID NO: 43942 - DNA, 21 bp, Artificial Sequence
  Synthetic Construct
cccctgttgtgctgagagttt

SEQ ID NO: 43943 - DNA, 26 bp, Artificial Sequence
  Synthetic Construct
gaactgataaacagtgtcccatctct

SEQ ID NO: 43944 - DNA, 22 bp, Artificial Sequence
  Synthetic Construct
tcccacggagagtgaagagaaa

SEQ ID NO: 43945 - DNA, 18 bp, Artificial Sequence
  Synthetic Construct
tggctgcaggcgtcactt

SEQ ID NO: 43946 - DNA, 21 bp, Artificial Sequence
  Synthetic Construct
actgcctcgaatcagccaatg

SEQ ID NO: 43947 - DNA, 22 bp, Artificial Sequence
  Synthetic Construct
tcctcactccattccctccatt

SEQ ID NO: 43948 - DNA, 22 bp, Artificial Sequence
  Synthetic Construct
tccctgctggttctgccttaga

SEQ ID NO: 43949 - DNA, 23 bp, Artificial Sequence
  Synthetic Construct
gtcacgggtacagcacatagtct

SEQ ID NO: 43950 - DNA, 22 bp, Artificial Sequence
  Synthetic Construct
cactgtgttgggccctgaaata

SEQ ID NO: 43951 - DNA, 20 bp, Artificial Sequence
  Synthetic Construct
aggctggagccataggatca

SEQ ID NO: 43952 - DNA, 21 bp, Artificial Sequence
  Synthetic Construct
agcctagggctctcaaactct

SEQ ID NO: 43953 - DNA, 22 bp, Artificial Sequence
  Synthetic Construct
ggctttaacatgcccacgagat

SEQ ID NO: 43954 - DNA, 21 bp, Artificial Sequence
  Synthetic Construct
caaggcagggattgaggcaaa

SEQ ID NO: 43955 - DNA, 20 bp, Artificial Sequence
  Synthetic Construct
aaaacggcggggtgggcaaa

SEQ ID NO: 43956 - DNA, 22 bp, Artificial Sequence
  Synthetic Construct
cctcaggagacagatgcagtga

SEQ ID NO: 43957 - DNA, 25 bp, Artificial Sequence
  Synthetic Construct
gctttaaagatcacatgctgccatt

SEQ ID NO: 43958 - DNA, 22 bp, Artificial Sequence
  Synthetic Construct
ggagtcaaagcttccacgtagt

SEQ ID NO: 43959 - DNA, 18 bp, Artificial Sequence
  Synthetic Construct
agcctgtggcgctttgtt

SEQ ID NO: 43960 - DNA, 19 bp, Artificial Sequence
  Synthetic Construct
ccggcatgcagacactcaa

SEQ ID NO: 43961 - DNA, 26 bp, Artificial Sequence
  Synthetic Construct
tcggatagatcttataccacctgtgt

SEQ ID NO: 43962 - DNA, 22 bp, Artificial Sequence
  Synthetic Construct
gaggcacggtagacatttcctt

SEQ ID NO: 43963 - DNA, 21 bp, Artificial Sequence
  Synthetic Construct
tgtttctgcaagcctcagtgt

SEQ ID NO: 43964 - DNA, 26 bp, Artificial Sequence
  Synthetic Construct
ccctacagacagtagtccctttattg

SEQ ID NO: 43965 - DNA, 22 bp, Artificial Sequence
  Synthetic Construct
tggcacctatgactgacacttg

SEQ ID NO: 43966 - DNA, 23 bp, Artificial Sequence
  Synthetic Construct
cggagagatgaagtggtttgctt

SEQ ID NO: 43967 - DNA, 19 bp, Artificial Sequence
  Synthetic Construct
agctggggtgggcagacta

SEQ ID NO: 43968 - DNA, 19 bp, Artificial Sequence
  Synthetic Construct
cccttctcaggcggtgctt

SEQ ID NO: 43969 - DNA, 20 bp, Artificial Sequence
  Synthetic Construct
cgtaggcagccttccacgta

SEQ ID NO: 43970 - DNA, 26 bp, Artificial Sequence
  Synthetic Construct
cacatgctattcccttatgcctggta

SEQ ID NO: 43971 - DNA, 26 bp, Artificial Sequence
  Synthetic Construct
ccttcagtatctccacacccacttct

SEQ ID NO: 43972 - DNA, 20 bp, Artificial Sequence
  Synthetic Construct
ctgggcacccagctaaactt

SEQ ID NO: 43973 - DNA, 23 bp, Artificial Sequence
  Synthetic Construct
cccctgactgatgtgtccagaga

SEQ ID NO: 43974 - DNA, 25 bp, Artificial Sequence
  Synthetic Construct
gcacagtctggaaaccagtcgtcta

SEQ ID NO: 43975 - DNA, 20 bp, Artificial Sequence
  Synthetic Construct
agtgccagacagccctgaac

SEQ ID NO: 43976 - DNA, 23 bp, Artificial Sequence
  Synthetic Construct
acagactacagccaagcaatgat

SEQ ID NO: 43977 - DNA, 25 bp, Artificial Sequence
  Synthetic Construct
ggtactgatctgctgtcactggaaa

SEQ ID NO: 43978 - DNA, 25 bp, Artificial Sequence
  Synthetic Construct
tggcaccatttcagtgacattaaac

SEQ ID NO: 43979 - DNA, 26 bp, Artificial Sequence
  Synthetic Construct
gattgagaagcagtagtagcaggtat

SEQ ID NO: 43980 - DNA, 19 bp, Artificial Sequence
  Synthetic Construct
tccagcagctgtgctcgat

SEQ ID NO: 43981 - DNA, 24 bp, Artificial Sequence
  Synthetic Construct
ctagaggcaatacactccacactt

SEQ ID NO: 43982 - DNA, 20 bp, Artificial Sequence
  Synthetic Construct
acaccgcattgactgacaca

SEQ ID NO: 43983 - DNA, 22 bp, Artificial Sequence
  Synthetic Construct
gctgcacttgcagggatctaac

SEQ ID NO: 43984 - DNA, 20 bp, Artificial Sequence
  Synthetic Construct
tgctggagtgagcggagtgt

SEQ ID NO: 43985 - DNA, 24 bp, Artificial Sequence
  Synthetic Construct
ctgtttatctcagcccacatggta

SEQ ID NO: 43986 - DNA, 20 bp, Artificial Sequence
  Synthetic Construct
ccacccaaagaacccgaaga

SEQ ID NO: 43987 - DNA, 21 bp, Artificial Sequence
  Synthetic Construct
cacagaccaggttcagcatca

SEQ ID NO: 43988 - DNA, 22 bp, Artificial Sequence
  Synthetic Construct
ggcccatcagattctgcacttg

SEQ ID NO: 43989 - DNA, 19 bp, Artificial Sequence
  Synthetic Construct
ttgtgcctcccaggtctca

SEQ ID NO: 43990 - DNA, 19 bp, Artificial Sequence
  Synthetic Construct
ttgccatgaaccgccttct

SEQ ID NO: 43991 - DNA, 20 bp, Artificial Sequence
  Synthetic Construct
ccgcacggccctatctcatc

SEQ ID NO: 43992 - DNA, 23 bp, Artificial Sequence
  Synthetic Construct
cagagagccacaggaaccactaa

SEQ ID NO: 43993 - DNA, 20 bp, Artificial Sequence
  Synthetic Construct
tgtcacagcctcggaagcaa

SEQ ID NO: 43994 - DNA, 23 bp, Artificial Sequence
  Synthetic Construct
ggaagagtgttggtttgctctca

SEQ ID NO: 43995 - DNA, 18 bp, Artificial Sequence
  Synthetic Construct
aggcctatggggcacagt

SEQ ID NO: 43996 - DNA, 19 bp, Artificial Sequence
  Synthetic Construct
ccaggccagggagtgaaca

SEQ ID NO: 43997 - DNA, 20 bp, Artificial Sequence
  Synthetic Construct
tggcacacaccacaccttag

SEQ ID NO: 43998 - DNA, 20 bp, Artificial Sequence
  Synthetic Construct
ccttgtggccttggttcaga

SEQ ID NO: 43999 - DNA, 22 bp, Artificial Sequence
  Synthetic Construct
cccaacttgcccagtcctcttt

SEQ ID NO: 44000 - DNA, 20 bp, Artificial Sequence
  Synthetic Construct
gcagtcagcagagtgtccat

SEQ ID NO: 44001 - DNA, 20 bp, Artificial Sequence
  Synthetic Construct
agggcttggagggctccttt

SEQ ID NO: 44002 - DNA, 20 bp, Artificial Sequence
  Synthetic Construct
tggggtctccccttgcattt

SEQ ID NO: 44003 - DNA, 24 bp, Artificial Sequence
  Synthetic Construct
cggggataaacacttcctcctctt

SEQ ID NO: 44004 - DNA, 27 bp, Artificial Sequence
  Synthetic Construct
cgaactttcagtaaatacctgctgact

SEQ ID NO: 44005 - DNA, 19 bp, Artificial Sequence
  Synthetic Construct
accctgggcaaggtcatct

SEQ ID NO: 44006 - DNA, 25 bp, Artificial Sequence
  Synthetic Construct
ctggaagagagcacaagaggttgat

SEQ ID NO: 44007 - DNA, 20 bp, Artificial Sequence
  Synthetic Construct
ccgctgcatgtttggtgcat

SEQ ID NO: 44008 - DNA, 25 bp, Artificial Sequence
  Synthetic Construct
ggagactggtcaggaatacctccta

SEQ ID NO: 44009 - DNA, 24 bp, Artificial Sequence
  Synthetic Construct
gttcatgtgtttgccagagacttc

SEQ ID NO: 44010 - DNA, 22 bp, Artificial Sequence
  Synthetic Construct
gaggctcagaggagttgacttg

SEQ ID NO: 44011 - DNA, 18 bp, Artificial Sequence
  Synthetic Construct
tggccacctcacgacctt

SEQ ID NO: 44012 - DNA, 22 bp, Artificial Sequence
  Synthetic Construct
gctccagctgtacctacgtcaa

SEQ ID NO: 44013 - DNA, 21 bp, Artificial Sequence
  Synthetic Construct
gcagagagaggtgccagaaat

SEQ ID NO: 44014 - DNA, 26 bp, Artificial Sequence
  Synthetic Construct
gcatttttatctagcctgcctcgtat

SEQ ID NO: 44015 - DNA, 19 bp, Artificial Sequence
  Synthetic Construct
ccacccacctccccacttt

SEQ ID NO: 44016 - DNA, 22 bp, Artificial Sequence
  Synthetic Construct
tgtcacacccacctcccattag

SEQ ID NO: 44017 - DNA, 25 bp, Artificial Sequence
  Synthetic Construct
ggcaaaagtaaacacctgactcact

SEQ ID NO: 44018 - DNA, 20 bp, Artificial Sequence
  Synthetic Construct
tgcagcgtttgacccacact

SEQ ID NO: 44019 - DNA, 25 bp, Artificial Sequence
  Synthetic Construct
attggatcatcagatttggggaact

SEQ ID NO: 44020 - DNA, 26 bp, Artificial Sequence
  Synthetic Construct
gtgagagacctggaaatgcctgatag

SEQ ID NO: 44021 - DNA, 22 bp, Artificial Sequence
  Synthetic Construct
caagggacccaaaatgccctta

SEQ ID NO: 44022 - DNA, 22 bp, Artificial Sequence
  Synthetic Construct
caccaggcctttgcttgtccta

SEQ ID NO: 44023 - DNA, 22 bp, Artificial Sequence
  Synthetic Construct
gcaggtaaggagtcccttggaa

SEQ ID NO: 44024 - DNA, 24 bp, Artificial Sequence
  Synthetic Construct
tgaacagtctgcatgaaacacttg

SEQ ID NO: 44025 - DNA, 22 bp, Artificial Sequence
  Synthetic Construct
tccctcgtggggtgtatagtct

SEQ ID NO: 44026 - DNA, 21 bp, Artificial Sequence
  Synthetic Construct
ccctctgcctcatggtacaag

SEQ ID NO: 44027 - DNA, 20 bp, Artificial Sequence
  Synthetic Construct
tacctgggcacctgtgaaga

SEQ ID NO: 44028 - DNA, 22 bp, Artificial Sequence
  Synthetic Construct
ctccttgaggtctggtcgatct

SEQ ID NO: 44029 - DNA, 22 bp, Artificial Sequence
  Synthetic Construct
gttccaaaggccaccatggatt

SEQ ID NO: 44030 - DNA, 24 bp, Artificial Sequence
  Synthetic Construct
ttcctgagggtcatcctaaacaac

SEQ ID NO: 44031 - DNA, 20 bp, Artificial Sequence
  Synthetic Construct
tggttgtggctgagggtctt

SEQ ID NO: 44032 - DNA, 26 bp, Artificial Sequence
  Synthetic Construct
ggctgcatagggtaaatcacggttag

SEQ ID NO: 44033 - DNA, 24 bp, Artificial Sequence
  Synthetic Construct
cccatggaaaagagggcactgtca

SEQ ID NO: 44034 - DNA, 25 bp, Artificial Sequence
  Synthetic Construct
gcagaacaatgtactctccctaagt

SEQ ID NO: 44035 - DNA, 19 bp, Artificial Sequence
  Synthetic Construct
agtggagcacagccagtgt

SEQ ID NO: 44036 - DNA, 19 bp, Artificial Sequence
  Synthetic Construct
ccttggggttgggctcaga

SEQ ID NO: 44037 - DNA, 20 bp, Artificial Sequence
  Synthetic Construct
ctgtgccgcgtgtgacattt

SEQ ID NO: 44038 - DNA, 24 bp, Artificial Sequence
  Synthetic Construct
cccttgtgtgacatgggtaagaag

SEQ ID NO: 44039 - DNA, 21 bp, Artificial Sequence
  Synthetic Construct
ggccagatctgctcaccctaa

SEQ ID NO: 44040 - DNA, 23 bp, Artificial Sequence
  Synthetic Construct
cttgttttcaaggcagggaggaa

SEQ ID NO: 44041 - DNA, 21 bp, Artificial Sequence
  Synthetic Construct
agacttggggagccaatctga

SEQ ID NO: 44042 - DNA, 25 bp, Artificial Sequence
  Synthetic Construct
cgtgatcttgagaagcagccaaaac

SEQ ID NO: 44043 - DNA, 24 bp, Artificial Sequence
  Synthetic Construct
caccattactcccagtgacctact

SEQ ID NO: 44044 - DNA, 27 bp, Artificial Sequence
  Synthetic Construct
gaggagagacacaacttatgctttttg

SEQ ID NO: 44045 - DNA, 20 bp, Artificial Sequence
  Synthetic Construct
tgctccatgcaggtctgtgt

SEQ ID NO: 44046 - DNA, 24 bp, Artificial Sequence
  Synthetic Construct
ggcagattatcccgttaaccttgt

SEQ ID NO: 44047 - DNA, 19 bp, Artificial Sequence
  Synthetic Construct
tccgccctgccacatgcaa

SEQ ID NO: 44048 - DNA, 21 bp, Artificial Sequence
  Synthetic Construct
agaagaggggctatgccatga

SEQ ID NO: 44049 - DNA, 26 bp, Artificial Sequence
  Synthetic Construct
ccagggttcactgagatgtagtgtgt

SEQ ID NO: 44050 - DNA, 24 bp, Artificial Sequence
  Synthetic Construct
gagaaggctctaagcactcacctt

SEQ ID NO: 44051 - DNA, 26 bp, Artificial Sequence
  Synthetic Construct
ggtcctagttttcaatgcccacatac

SEQ ID NO: 44052 - DNA, 23 bp, Artificial Sequence
  Synthetic Construct
agatgagtggtgagtggcttttg

SEQ ID NO: 44053 - DNA, 21 bp, Artificial Sequence
  Synthetic Construct
tgctgtccctccagtgctctt

SEQ ID NO: 44054 - DNA, 23 bp, Artificial Sequence
  Synthetic Construct
ctcactgatgatggtggcagttc

SEQ ID NO: 44055 - DNA, 20 bp, Artificial Sequence
  Synthetic Construct
tcacccacactggacgtact

SEQ ID NO: 44056 - DNA, 21 bp, Artificial Sequence
  Synthetic Construct
acccaggatcaaggtgtcagt

SEQ ID NO: 44057 - DNA, 30 bp, Artificial Sequence
  Synthetic Construct
ggaaatgtgttctaccttgtaactgggata

SEQ ID NO: 44058 - DNA, 25 bp, Artificial Sequence
  Synthetic Construct
cctggtaggaagatccacaaagcat

SEQ ID NO: 44059 - DNA, 24 bp, Artificial Sequence
  Synthetic Construct
cagtctaggacacaaagagtgcaa

SEQ ID NO: 44060 - DNA, 25 bp, Artificial Sequence
  Synthetic Construct
ccagcatgtctctcagaggccattt

SEQ ID NO: 44061 - DNA, 20 bp, Artificial Sequence
  Synthetic Construct
aagggagctgcatggcagaa

SEQ ID NO: 44062 - DNA, 24 bp, Artificial Sequence
  Synthetic Construct
aactacaaacacacacctggaaga

SEQ ID NO: 44063 - DNA, 22 bp, Artificial Sequence
  Synthetic Construct
tctgcatgagcttgaactcgaa

SEQ ID NO: 44064 - DNA, 19 bp, Artificial Sequence
  Synthetic Construct
agagcagcagcacggtagt

SEQ ID NO: 44065 - DNA, 19 bp, Artificial Sequence
  Synthetic Construct
tcgggctcgggcttgaaat

SEQ ID NO: 44066 - DNA, 20 bp, Artificial Sequence
  Synthetic Construct
tccatgccattgctgagtgt

SEQ ID NO: 44067 - DNA, 22 bp, Artificial Sequence
  Synthetic Construct
aagcccacccaggatcaagaga

SEQ ID NO: 44068 - DNA, 22 bp, Artificial Sequence
  Synthetic Construct
gatgcaacaccctcgagttcta

SEQ ID NO: 44069 - DNA, 21 bp, Artificial Sequence
  Synthetic Construct
ccagccatcttggggcttcta

SEQ ID NO: 44070 - DNA, 25 bp, Artificial Sequence
  Synthetic Construct
ctgggtagtcaaggtcaattcaaac

SEQ ID NO: 44071 - DNA, 21 bp, Artificial Sequence
  Synthetic Construct
aacggaggacccacgctaact

SEQ ID NO: 44072 - DNA, 20 bp, Artificial Sequence
  Synthetic Construct
aactaggccccggttctgta

SEQ ID NO: 44073 - DNA, 26 bp, Artificial Sequence
  Synthetic Construct
gattgaaatctacctggctccaaatc

SEQ ID NO: 44074 - DNA, 22 bp, Artificial Sequence
  Synthetic Construct
gcagtgtttggtgggacacaga

SEQ ID NO: 44075 - DNA, 22 bp, Artificial Sequence
  Synthetic Construct
ttgccctccaggtctctacctt

SEQ ID NO: 44076 - DNA, 25 bp, Artificial Sequence
  Synthetic Construct
gcagatagtggacaatgaggcgaat

SEQ ID NO: 44077 - DNA, 20 bp, Artificial Sequence
  Synthetic Construct
gtcctccacttgcacaccaa

SEQ ID NO: 44078 - DNA, 19 bp, Artificial Sequence
  Synthetic Construct
gttgcagcatggggctagt

SEQ ID NO: 44079 - DNA, 25 bp, Artificial Sequence
  Synthetic Construct
ggggtttgacttgagtaactgagat

SEQ ID NO: 44080 - DNA, 25 bp, Artificial Sequence
  Synthetic Construct
gggtgttccctaaggaagtggtttc

SEQ ID NO: 44081 - DNA, 21 bp, Artificial Sequence
  Synthetic Construct
cagcttggcaaagacgagaag

SEQ ID NO: 44082 - DNA, 27 bp, Artificial Sequence
  Synthetic Construct
cacctcttctttgattccctgggatag

SEQ ID NO: 44083 - DNA, 23 bp, Artificial Sequence
  Synthetic Construct
ccttcagtccagctgaccacttc

SEQ ID NO: 44084 - DNA, 22 bp, Artificial Sequence
  Synthetic Construct
gcacacagtgagccttggtttc

SEQ ID NO: 44085 - DNA, 20 bp, Artificial Sequence
  Synthetic Construct
tggccttgcggagatgacaa

SEQ ID NO: 44086 - DNA, 26 bp, Artificial Sequence
  Synthetic Construct
gggagacagacttacatgcttaattg

SEQ ID NO: 44087 - DNA, 21 bp, Artificial Sequence
  Synthetic Construct
gccaggcacccagttgaagta

SEQ ID NO: 44088 - DNA, 19 bp, Artificial Sequence
  Synthetic Construct
ggccgctcccaacaactca

SEQ ID NO: 44089 - DNA, 24 bp, Artificial Sequence
  Synthetic Construct
ggaaagcccctgggtatggagata

SEQ ID NO: 44090 - DNA, 20 bp, Artificial Sequence
  Synthetic Construct
tccggtcctccctgtccatt

SEQ ID NO: 44091 - DNA, 30 bp, Artificial Sequence
  Synthetic Construct
gagatgactattcgttcccttattgccatt

SEQ ID NO: 44092 - DNA, 21 bp, Artificial Sequence
  Synthetic Construct
tgacccttgtgggtggcagta

SEQ ID NO: 44093 - DNA, 29 bp, Artificial Sequence
  Synthetic Construct
ggcttctgagaatgactttcacccttgat

SEQ ID NO: 44094 - DNA, 24 bp, Artificial Sequence
  Synthetic Construct
gcccatgtagctttaggaaagtgt

SEQ ID NO: 44095 - DNA, 24 bp, Artificial Sequence
  Synthetic Construct
acattcacagctttgatgcctaca

SEQ ID NO: 44096 - DNA, 22 bp, Artificial Sequence
  Synthetic Construct
ggaggttgtgccaaagccactt

SEQ ID NO: 44097 - DNA, 20 bp, Artificial Sequence
  Synthetic Construct
gaaaacgcacgggactcaga

SEQ ID NO: 44098 - DNA, 22 bp, Artificial Sequence
  Synthetic Construct
ctgggcagtccatgactgattg

SEQ ID NO: 44099 - DNA, 24 bp, Artificial Sequence
  Synthetic Construct
ggtcccaagatgtcagtcgcagtt

SEQ ID NO: 44100 - DNA, 23 bp, Artificial Sequence
  Synthetic Construct
gagacagacatgacgggacttga

SEQ ID NO: 44101 - DNA, 23 bp, Artificial Sequence
  Synthetic Construct
cagagctcaaagctcaggacttc

SEQ ID NO: 44102 - DNA, 22 bp, Artificial Sequence
  Synthetic Construct
ccctgggagggttttgaaccaa

SEQ ID NO: 44103 - DNA, 23 bp, Artificial Sequence
  Synthetic Construct
gaaaggcatggatatggcacaga

SEQ ID NO: 44104 - DNA, 24 bp, Artificial Sequence
  Synthetic Construct
cagacgtagagcttgaggttcaca

SEQ ID NO: 44105 - DNA, 25 bp, Artificial Sequence
  Synthetic Construct
gctacaggatacaatgaggttgtct

SEQ ID NO: 44106 - DNA, 23 bp, Artificial Sequence
  Synthetic Construct
cccaggaatgccttccagcttag

SEQ ID NO: 44107 - DNA, 20 bp, Artificial Sequence
  Synthetic Construct
atgtgccaggaacgatgtgt

SEQ ID NO: 44108 - DNA, 20 bp, Artificial Sequence
  Synthetic Construct
ttggtgaacagtgccacctt

SEQ ID NO: 44109 - DNA, 21 bp, Artificial Sequence
  Synthetic Construct
tggatctgtgcctgcctcaac

SEQ ID NO: 44110 - DNA, 20 bp, Artificial Sequence
  Synthetic Construct
tccagagatggaggctgctt

SEQ ID NO: 44111 - DNA, 23 bp, Artificial Sequence
  Synthetic Construct
tccctgtgtgtctcccagtgtag

SEQ ID NO: 44112 - DNA, 22 bp, Artificial Sequence
  Synthetic Construct
cccatttgctgcactggtcttg

SEQ ID NO: 44113 - DNA, 25 bp, Artificial Sequence
  Synthetic Construct
acttcatggagaagatggtgtttga

SEQ ID NO: 44114 - DNA, 20 bp, Artificial Sequence
  Synthetic Construct
gccaaagcaaggccagatgt

SEQ ID NO: 44115 - DNA, 22 bp, Artificial Sequence
  Synthetic Construct
gggccaaggaacccaatactga

SEQ ID NO: 44116 - DNA, 20 bp, Artificial Sequence
  Synthetic Construct
aggctgtctctggcaactga

SEQ ID NO: 44117 - DNA, 22 bp, Artificial Sequence
  Synthetic Construct
gtccccaggaatgtgacctttg

SEQ ID NO: 44118 - DNA, 25 bp, Artificial Sequence
  Synthetic Construct
cctcagaatttcacagtgcctgttc

SEQ ID NO: 44119 - DNA, 21 bp, Artificial Sequence
  Synthetic Construct
tggacctgctaagctccagaa

SEQ ID NO: 44120 - DNA, 21 bp, Artificial Sequence
  Synthetic Construct
cgctcctttccaccccagatt

SEQ ID NO: 44121 - DNA, 22 bp, Artificial Sequence
  Synthetic Construct
tttccctttgatggctccaact

SEQ ID NO: 44122 - DNA, 22 bp, Artificial Sequence
  Synthetic Construct
ggagggaggtagaagggcaact

SEQ ID NO: 44123 - DNA, 18 bp, Artificial Sequence
  Synthetic Construct
agcacctggaggcgctta

SEQ ID NO: 44124 - DNA, 20 bp, Artificial Sequence
  Synthetic Construct
tgccgtggctgcttcttcaa

SEQ ID NO: 44125 - DNA, 26 bp, Artificial Sequence
  Synthetic Construct
gcttacactctttcagactggatact

SEQ ID NO: 44126 - DNA, 22 bp, Artificial Sequence
  Synthetic Construct
tggcacctacaccttcctgaac

SEQ ID NO: 44127 - DNA, 21 bp, Artificial Sequence
  Synthetic Construct
ggcaccaaggccctccataat

SEQ ID NO: 44128 - DNA, 22 bp, Artificial Sequence
  Synthetic Construct
tcttcctctcctaccccagact

SEQ ID NO: 44129 - DNA, 24 bp, Artificial Sequence
  Synthetic Construct
atcatggaaggaagtgcttgatct

SEQ ID NO: 44130 - DNA, 20 bp, Artificial Sequence
  Synthetic Construct
actccaccaaggcacagaca

SEQ ID NO: 44131 - DNA, 22 bp, Artificial Sequence
  Synthetic Construct
tctctgacacagtggggtatca

SEQ ID NO: 44132 - DNA, 23 bp, Artificial Sequence
  Synthetic Construct
cccacattagcagagaccactga

SEQ ID NO: 44133 - DNA, 24 bp, Artificial Sequence
  Synthetic Construct
ggtgagagagcagcaagtgacctt

SEQ ID NO: 44134 - DNA, 24 bp, Artificial Sequence
  Synthetic Construct
agggaaacttcattctgggttcat

SEQ ID NO: 44135 - DNA, 22 bp, Artificial Sequence
  Synthetic Construct
tcgccccttcccacctttactt

SEQ ID NO: 44136 - DNA, 22 bp, Artificial Sequence
  Synthetic Construct
ggtaggtcaggcagcaatcaag

SEQ ID NO: 44137 - DNA, 27 bp, Artificial Sequence
  Synthetic Construct
ccttccacttacagcttagttcctgta

SEQ ID NO: 44138 - DNA, 21 bp, Artificial Sequence
  Synthetic Construct
tcccgtacacctccctgctaa

SEQ ID NO: 44139 - DNA, 21 bp, Artificial Sequence
  Synthetic Construct
tggctgtacccaggcatggaa

SEQ ID NO: 44140 - DNA, 23 bp, Artificial Sequence
  Synthetic Construct
cagtgtgtccagccactaacttc

SEQ ID NO: 44141 - DNA, 22 bp, Artificial Sequence
  Synthetic Construct
ggccacttgacctctcctgaaa

SEQ ID NO: 44142 - DNA, 25 bp, Artificial Sequence
  Synthetic Construct
ggggaaaggtaagagtgagcatgaa

SEQ ID NO: 44143 - DNA, 19 bp, Artificial Sequence
  Synthetic Construct
tgctgggccactgttgcat

SEQ ID NO: 44144 - DNA, 23 bp, Artificial Sequence
  Synthetic Construct
gagccttctgactgaccttggta

SEQ ID NO: 44145 - DNA, 20 bp, Artificial Sequence
  Synthetic Construct
gggcagtgctgaggtaaagt

SEQ ID NO: 44146 - DNA, 24 bp, Artificial Sequence
  Synthetic Construct
gtggtggttagggaaatcgaggaa

SEQ ID NO: 44147 - DNA, 22 bp, Artificial Sequence
  Synthetic Construct
cccatgaagcaggagtgaggaa

SEQ ID NO: 44148 - DNA, 22 bp, Artificial Sequence
  Synthetic Construct
ggggaaggtagtgaagcaagtt

SEQ ID NO: 44149 - DNA, 20 bp, Artificial Sequence
  Synthetic Construct
aagctcaccaggccctgact

SEQ ID NO: 44150 - DNA, 21 bp, Artificial Sequence
  Synthetic Construct
tccttcacccctccacctgta

SEQ ID NO: 44151 - DNA, 22 bp, Artificial Sequence
  Synthetic Construct
agcccttacagtggcctacaag

SEQ ID NO: 44152 - DNA, 21 bp, Artificial Sequence
  Synthetic Construct
gtttggcagtgctgttgttca

SEQ ID NO: 44153 - DNA, 19 bp, Artificial Sequence
  Synthetic Construct
tcaagggtgcctggtcagt

SEQ ID NO: 44154 - DNA, 22 bp, Artificial Sequence
  Synthetic Construct
cggttcagccacaggttgtaag

SEQ ID NO: 44155 - DNA, 24 bp, Artificial Sequence
  Synthetic Construct
acaaaggattgaggtgttgcctat

SEQ ID NO: 44156 - DNA, 26 bp, Artificial Sequence
  Synthetic Construct
gcaggataaggctttcaaacgagctt

SEQ ID NO: 44157 - DNA, 23 bp, Artificial Sequence
  Synthetic Construct
ccttcagatgcactcgacagttc

SEQ ID NO: 44158 - DNA, 21 bp, Artificial Sequence
  Synthetic Construct
gccaaagcacccgtaccctaa

SEQ ID NO: 44159 - DNA, 25 bp, Artificial Sequence
  Synthetic Construct
gcactggtggaactttcaaagcaat

SEQ ID NO: 44160 - DNA, 21 bp, Artificial Sequence
  Synthetic Construct
agggcatggaagtgttccaaa

SEQ ID NO: 44161 - DNA, 22 bp, Artificial Sequence
  Synthetic Construct
cacattccagtgctccacaaag

SEQ ID NO: 44162 - DNA, 28 bp, Artificial Sequence
  Synthetic Construct
gtctcaattctgaacgagtcttcccttt

SEQ ID NO: 44163 - DNA, 20 bp, Artificial Sequence
  Synthetic Construct
ggagcaaaagctcgccacaa

SEQ ID NO: 44164 - DNA, 24 bp, Artificial Sequence
  Synthetic Construct
acttctgtgcgtaaagtcaaggaa

SEQ ID NO: 44165 - DNA, 22 bp, Artificial Sequence
  Synthetic Construct
gtgaactgagtcggaccgaaag

SEQ ID NO: 44166 - DNA, 22 bp, Artificial Sequence
  Synthetic Construct
gttaggctcctttgccccaaaa

SEQ ID NO: 44167 - DNA, 27 bp, Artificial Sequence
  Synthetic Construct
gacaccttggctgatagaaaaatgcaa

SEQ ID NO: 44168 - DNA, 22 bp, Artificial Sequence
  Synthetic Construct
ggggcagaacaatgctgacctt

SEQ ID NO: 44169 - DNA, 27 bp, Artificial Sequence
  Synthetic Construct
gaggtgttattattgttgcagcgattg

SEQ ID NO: 44170 - DNA, 23 bp, Artificial Sequence
  Synthetic Construct
ctgcctcaatctccccatgaaag

SEQ ID NO: 44171 - DNA, 22 bp, Artificial Sequence
  Synthetic Construct
gtcaagagcacaccacttgctt

SEQ ID NO: 44172 - DNA, 22 bp, Artificial Sequence
  Synthetic Construct
cagcaggtgacatctggagtag

SEQ ID NO: 44173 - DNA, 22 bp, Artificial Sequence
  Synthetic Construct
ccctttggtaggtgcggagaaa

SEQ ID NO: 44174 - DNA, 24 bp, Artificial Sequence
  Synthetic Construct
gggatcagaacccatggagacaac

SEQ ID NO: 44175 - DNA, 24 bp, Artificial Sequence
  Synthetic Construct
acctcacctacaaacacacacttg

SEQ ID NO: 44176 - DNA, 22 bp, Artificial Sequence
  Synthetic Construct
ccccagcttcacgcttctcaat

SEQ ID NO: 44177 - DNA, 24 bp, Artificial Sequence
  Synthetic Construct
cctcatagtgccaggccttaggtt

SEQ ID NO: 44178 - DNA, 21 bp, Artificial Sequence
  Synthetic Construct
aggcatcacctcctcgacaga

SEQ ID NO: 44179 - DNA, 22 bp, Artificial Sequence
  Synthetic Construct
agactaggcactgttcctctga

SEQ ID NO: 44180 - DNA, 22 bp, Artificial Sequence
  Synthetic Construct
aagtagttggccacctgtgaaa

SEQ ID NO: 44181 - DNA, 28 bp, Artificial Sequence
  Synthetic Construct
ccatataaagtcagtcctctcaggcata

SEQ ID NO: 44182 - DNA, 23 bp, Artificial Sequence
  Synthetic Construct
ctgtggtgagttggagggaaagt

SEQ ID NO: 44183 - DNA, 24 bp, Artificial Sequence
  Synthetic Construct
ctcaaagtgaaccagcccaaatag

SEQ ID NO: 44184 - DNA, 21 bp, Artificial Sequence
  Synthetic Construct
agccacaggctggtctctgtt

SEQ ID NO: 44185 - DNA, 24 bp, Artificial Sequence
  Synthetic Construct
ggttgaagctgtgaggttggttag

SEQ ID NO: 44186 - DNA, 25 bp, Artificial Sequence
  Synthetic Construct
aaaatgtacctggttggagtagctt

SEQ ID NO: 44187 - DNA, 22 bp, Artificial Sequence
  Synthetic Construct
gtccttccagaagcctcagcat

SEQ ID NO: 44188 - DNA, 25 bp, Artificial Sequence
  Synthetic Construct
gcctgtaggtgtcctaagaatgact

SEQ ID NO: 44189 - DNA, 26 bp, Artificial Sequence
  Synthetic Construct
cattctaggcatgtgagagtaaggaa

SEQ ID NO: 44190 - DNA, 24 bp, Artificial Sequence
  Synthetic Construct
gccagatccatatgctcctcaaag

SEQ ID NO: 44191 - DNA, 27 bp, Artificial Sequence
  Synthetic Construct
gctgaccaccagacaattactgcattt

SEQ ID NO: 44192 - DNA, 20 bp, Artificial Sequence
  Synthetic Construct
tgctgtactctggggctgta

SEQ ID NO: 44193 - DNA, 22 bp, Artificial Sequence
  Synthetic Construct
tgctgtccccttcaggatagaa

SEQ ID NO: 44194 - DNA, 24 bp, Artificial Sequence
  Synthetic Construct
cactcagtttcaagggcctaccta

SEQ ID NO: 44195 - DNA, 21 bp, Artificial Sequence
  Synthetic Construct
taccacagcccatggcacaga

SEQ ID NO: 44196 - DNA, 24 bp, Artificial Sequence
  Synthetic Construct
agccattattctggcattgagaca

SEQ ID NO: 44197 - DNA, 23 bp, Artificial Sequence
  Synthetic Construct
gccagggagaccaaatcctttgt

SEQ ID NO: 44198 - DNA, 21 bp, Artificial Sequence
  Synthetic Construct
gccagccatcaccaatgactt

SEQ ID NO: 44199 - DNA, 20 bp, Artificial Sequence
  Synthetic Construct
cgctgtcagtggtgctactt

SEQ ID NO: 44200 - DNA, 24 bp, Artificial Sequence
  Synthetic Construct
ggagagaattagccaaccctgtaa

SEQ ID NO: 44201 - DNA, 21 bp, Artificial Sequence
  Synthetic Construct
accaagccatccagcctccat

SEQ ID NO: 44202 - DNA, 21 bp, Artificial Sequence
  Synthetic Construct
tccaatgccacccagcaccta

SEQ ID NO: 44203 - DNA, 23 bp, Artificial Sequence
  Synthetic Construct
gttgtgaccatttttgccacctt

SEQ ID NO: 44204 - DNA, 21 bp, Artificial Sequence
  Synthetic Construct
cttcctccacaggctgtccta

SEQ ID NO: 44205 - DNA, 20 bp, Artificial Sequence
  Synthetic Construct
ctgccctttgtggtggaagt

SEQ ID NO: 44206 - DNA, 22 bp, Artificial Sequence
  Synthetic Construct
ccacaggccttagctccaatca

SEQ ID NO: 44207 - DNA, 21 bp, Artificial Sequence
  Synthetic Construct
ccattcctatcgccccagttt

SEQ ID NO: 44208 - DNA, 25 bp, Artificial Sequence
  Synthetic Construct
acttagcaagctatgaggctacttc

SEQ ID NO: 44209 - DNA, 25 bp, Artificial Sequence
  Synthetic Construct
ccaggaactatgcatgattcagaac

SEQ ID NO: 44210 - DNA, 18 bp, Artificial Sequence
  Synthetic Construct
acgtctggcgcgtgttgt

SEQ ID NO: 44211 - DNA, 23 bp, Artificial Sequence
  Synthetic Construct
gcccagtcacacctttcaacttc

SEQ ID NO: 44212 - DNA, 27 bp, Artificial Sequence
  Synthetic Construct
ggccaagatgagaaagtaggtggacat

SEQ ID NO: 44213 - DNA, 27 bp, Artificial Sequence
  Synthetic Construct
tgacattctaaccctatttcccacttg

SEQ ID NO: 44214 - DNA, 23 bp, Artificial Sequence
  Synthetic Construct
cagaaatgggtgcaaggaagcaa

SEQ ID NO: 44215 - DNA, 24 bp, Artificial Sequence
  Synthetic Construct
cccagaaaatgtgagccatgaaga

SEQ ID NO: 44216 - DNA, 22 bp, Artificial Sequence
  Synthetic Construct
cccaaggtggccattaaaggaa

SEQ ID NO: 44217 - DNA, 25 bp, Artificial Sequence
  Synthetic Construct
gaccaccattattgctcctctgaac

SEQ ID NO: 44218 - DNA, 23 bp, Artificial Sequence
  Synthetic Construct
ggtaccctggcagtactttctgt

SEQ ID NO: 44219 - DNA, 23 bp, Artificial Sequence
  Synthetic Construct
attctccatgtgtcaaccgtctt

SEQ ID NO: 44220 - DNA, 27 bp, Artificial Sequence
  Synthetic Construct
cagggataactgctcatgtaaggtact

SEQ ID NO: 44221 - DNA, 24 bp, Artificial Sequence
  Synthetic Construct
cggaccaatgacagaaatggttag

SEQ ID NO: 44222 - DNA, 19 bp, Artificial Sequence
  Synthetic Construct
ggacggctgggtttccttt

SEQ ID NO: 44223 - DNA, 21 bp, Artificial Sequence
  Synthetic Construct
tggtcaatgggaatggcatgt

SEQ ID NO: 44224 - DNA, 24 bp, Artificial Sequence
  Synthetic Construct
cctgaaactagtcacagcctctca

SEQ ID NO: 44225 - DNA, 23 bp, Artificial Sequence
  Synthetic Construct
ggtaatggacagtgtcagcttct

SEQ ID NO: 44226 - DNA, 20 bp, Artificial Sequence
  Synthetic Construct
acttctccagccacccaatg

SEQ ID NO: 44227 - DNA, 23 bp, Artificial Sequence
  Synthetic Construct
tccagatagcccaaagaggtgaa

SEQ ID NO: 44228 - DNA, 21 bp, Artificial Sequence
  Synthetic Construct
gccatagacagttggggtcaa

SEQ ID NO: 44229 - DNA, 22 bp, Artificial Sequence
  Synthetic Construct
gcttatgggtggcttggagcat

SEQ ID NO: 44230 - DNA, 22 bp, Artificial Sequence
  Synthetic Construct
ccaatcccctgctccttgacat

SEQ ID NO: 44231 - DNA, 21 bp, Artificial Sequence
  Synthetic Construct
gtccatgccttagctgcaaga

SEQ ID NO: 44232 - DNA, 22 bp, Artificial Sequence
  Synthetic Construct
ggtgagggcatggactttgtag

SEQ ID NO: 44233 - DNA, 21 bp, Artificial Sequence
  Synthetic Construct
ttctggccacaccctcgctta

SEQ ID NO: 44234 - DNA, 21 bp, Artificial Sequence
  Synthetic Construct
tgtgctaggtaggcccagtaa

SEQ ID NO: 44235 - DNA, 26 bp, Artificial Sequence
  Synthetic Construct
ggggaggttttatcagtaccctttta

SEQ ID NO: 44236 - DNA, 25 bp, Artificial Sequence
  Synthetic Construct
ggaaagacacagtggttcccaaatc

SEQ ID NO: 44237 - DNA, 25 bp, Artificial Sequence
  Synthetic Construct
gtcttttaaacagttgcctcacaca

SEQ ID NO: 44238 - DNA, 23 bp, Artificial Sequence
  Synthetic Construct
ctgtgagttccatcagggaagaa

SEQ ID NO: 44239 - DNA, 26 bp, Artificial Sequence
  Synthetic Construct
ggatgatggggagagtcctgtgtatt

SEQ ID NO: 44240 - DNA, 24 bp, Artificial Sequence
  Synthetic Construct
ggtctcttgaagacaggattccat

SEQ ID NO: 44241 - DNA, 22 bp, Artificial Sequence
  Synthetic Construct
gcctgacacagacagagagcaa

SEQ ID NO: 44242 - DNA, 25 bp, Artificial Sequence
  Synthetic Construct
tgtacttcaaactctgcatgtccaa

SEQ ID NO: 44243 - DNA, 22 bp, Artificial Sequence
  Synthetic Construct
ctggagctagagcagtggcaat

SEQ ID NO: 44244 - DNA, 22 bp, Artificial Sequence
  Synthetic Construct
gctgggttgctctccacaagaa

SEQ ID NO: 44245 - DNA, 25 bp, Artificial Sequence
  Synthetic Construct
gccctacagaaaactttgggtctct

SEQ ID NO: 44246 - DNA, 22 bp, Artificial Sequence
  Synthetic Construct
gccatcttggctcccaatgcaa

SEQ ID NO: 44247 - DNA, 25 bp, Artificial Sequence
  Synthetic Construct
cctcactaaagtttgggtgcaggaa

SEQ ID NO: 44248 - DNA, 22 bp, Artificial Sequence
  Synthetic Construct
ttccatgcaaagcaaggggtat

SEQ ID NO: 44249 - DNA, 21 bp, Artificial Sequence
  Synthetic Construct
gcaagggaatccaggggcatt

SEQ ID NO: 44250 - DNA, 20 bp, Artificial Sequence
  Synthetic Construct
accctgagtgagccagcaaa

SEQ ID NO: 44251 - DNA, 27 bp, Artificial Sequence
  Synthetic Construct
aggaagcaaagagatcttaggatcaag

SEQ ID NO: 44252 - DNA, 22 bp, Artificial Sequence
  Synthetic Construct
aacaggcccagtctcactatct

SEQ ID NO: 44253 - DNA, 24 bp, Artificial Sequence
  Synthetic Construct
cccgagggaaaacaagagctggaa

SEQ ID NO: 44254 - DNA, 26 bp, Artificial Sequence
  Synthetic Construct
ggcaggttaggtattagcaggaaatg

SEQ ID NO: 44255 - DNA, 20 bp, Artificial Sequence
  Synthetic Construct
ggctgctggcctcatttact

SEQ ID NO: 44256 - DNA, 25 bp, Artificial Sequence
  Synthetic Construct
gtcttgacagactagccttctgtag

SEQ ID NO: 44257 - DNA, 21 bp, Artificial Sequence
  Synthetic Construct
tgtcagaaggaaggggtgact

SEQ ID NO: 44258 - DNA, 22 bp, Artificial Sequence
  Synthetic Construct
gtgctgtgctaggtgcaaggta

SEQ ID NO: 44259 - DNA, 25 bp, Artificial Sequence
  Synthetic Construct
acaaggtttatgtaacggccttgaa

SEQ ID NO: 44260 - DNA, 26 bp, Artificial Sequence
  Synthetic Construct
gggaaaatctatgccatgaggacaca

SEQ ID NO: 44261 - DNA, 23 bp, Artificial Sequence
  Synthetic Construct
tgagacacagggaggcccatatc

SEQ ID NO: 44262 - DNA, 24 bp, Artificial Sequence
  Synthetic Construct
gggattgggattgttgccaagttc

SEQ ID NO: 44263 - DNA, 24 bp, Artificial Sequence
  Synthetic Construct
gactagcatatggtggtggctact

SEQ ID NO: 44264 - DNA, 25 bp, Artificial Sequence
  Synthetic Construct
ggtggggtacctagattcagaaaca

SEQ ID NO: 44265 - DNA, 23 bp, Artificial Sequence
  Synthetic Construct
ccacaaactcccaggacatctct

SEQ ID NO: 44266 - DNA, 20 bp, Artificial Sequence
  Synthetic Construct
taccaccgccgagaatggaa

SEQ ID NO: 44267 - DNA, 22 bp, Artificial Sequence
  Synthetic Construct
agggtcccagtcaagcaggtaa

SEQ ID NO: 44268 - DNA, 23 bp, Artificial Sequence
  Synthetic Construct
gccatggccacaaataggcagtt

SEQ ID NO: 44269 - DNA, 19 bp, Artificial Sequence
  Synthetic Construct
gggcagaggggctttgaca

SEQ ID NO: 44270 - DNA, 20 bp, Artificial Sequence
  Synthetic Construct
cagatgagggtgctgccttt

SEQ ID NO: 44271 - DNA, 24 bp, Artificial Sequence
  Synthetic Construct
ggactccttccagcatctgtgaga

SEQ ID NO: 44272 - DNA, 25 bp, Artificial Sequence
  Synthetic Construct
tgcccacatttaaaaggcatagagt

SEQ ID NO: 44273 - DNA, 20 bp, Artificial Sequence
  Synthetic Construct
ctggtttggggaagcacagt

SEQ ID NO: 44274 - DNA, 22 bp, Artificial Sequence
  Synthetic Construct
cctgctcgtgtttctgggatga

SEQ ID NO: 44275 - DNA, 23 bp, Artificial Sequence
  Synthetic Construct
gggagaacagggtagggacattg

SEQ ID NO: 44276 - DNA, 19 bp, Artificial Sequence
  Synthetic Construct
tggctggcagcgagagctt

SEQ ID NO: 44277 - DNA, 24 bp, Artificial Sequence
  Synthetic Construct
ctgaggcagaaagtttgggtcagt

SEQ ID NO: 44278 - DNA, 24 bp, Artificial Sequence
  Synthetic Construct
tgtcccagttttgacagaggaaac

SEQ ID NO: 44279 - DNA, 20 bp, Artificial Sequence
  Synthetic Construct
ggggaatgtggaggggatga

SEQ ID NO: 44280 - DNA, 24 bp, Artificial Sequence
  Synthetic Construct
gacagttgcttagggcagaagatt

SEQ ID NO: 44281 - DNA, 24 bp, Artificial Sequence
  Synthetic Construct
ccccagataactatgggcttggat

SEQ ID NO: 44282 - DNA, 25 bp, Artificial Sequence
  Synthetic Construct
caaggaaaacattcaggacttggtt

SEQ ID NO: 44283 - DNA, 21 bp, Artificial Sequence
  Synthetic Construct
caacggaaacacaggggtcta

SEQ ID NO: 44284 - DNA, 26 bp, Artificial Sequence
  Synthetic Construct
gagtttcaaggcttaacctgttcctt

SEQ ID NO: 44285 - DNA, 22 bp, Artificial Sequence
  Synthetic Construct
gggtgagttgaaatgccacaaa

SEQ ID NO: 44286 - DNA, 24 bp, Artificial Sequence
  Synthetic Construct
tcccattacaaaggctgtttcaga

SEQ ID NO: 44287 - DNA, 19 bp, Artificial Sequence
  Synthetic Construct
agagggccctacccagtga

SEQ ID NO: 44288 - DNA, 20 bp, Artificial Sequence
  Synthetic Construct
tgcgggccaagaatccagaa

SEQ ID NO: 44289 - DNA, 28 bp, Artificial Sequence
  Synthetic Construct
ggactctacaagatcctgctgtagacat

SEQ ID NO: 44290 - DNA, 25 bp, Artificial Sequence
  Synthetic Construct
ggagaagatttcacgggaagtcaaa

SEQ ID NO: 44291 - DNA, 22 bp, Artificial Sequence
  Synthetic Construct
cttggttttgacctcccggaat

SEQ ID NO: 44292 - DNA, 22 bp, Artificial Sequence
  Synthetic Construct
gagttgaggcttttgggtgtca

SEQ ID NO: 44293 - DNA, 26 bp, Artificial Sequence
  Synthetic Construct
gtgattggttgcacgtagttgctaag

SEQ ID NO: 44294 - DNA, 24 bp, Artificial Sequence
  Synthetic Construct
accaatgttccctttctgactgat

SEQ ID NO: 44295 - DNA, 19 bp, Artificial Sequence
  Synthetic Construct
gcttccggctggccatctt

SEQ ID NO: 44296 - DNA, 22 bp, Artificial Sequence
  Synthetic Construct
ctgttcacaaaccggagcacaa

SEQ ID NO: 44297 - DNA, 24 bp, Artificial Sequence
  Synthetic Construct
cacaccatcgtatacacaccaaca

SEQ ID NO: 44298 - DNA, 22 bp, Artificial Sequence
  Synthetic Construct
ggagagctgcattcgcttcatc

SEQ ID NO: 44299 - DNA, 25 bp, Artificial Sequence
  Synthetic Construct
gccttgttcccagtcttaggaggaa

SEQ ID NO: 44300 - DNA, 21 bp, Artificial Sequence
  Synthetic Construct
accctccatcagtggagcttt

SEQ ID NO: 44301 - DNA, 24 bp, Artificial Sequence
  Synthetic Construct
ctttggttaatgcacagcatggaa

SEQ ID NO: 44302 - DNA, 23 bp, Artificial Sequence
  Synthetic Construct
tgctgaggtcaaggcactaaaag

SEQ ID NO: 44303 - DNA, 20 bp, Artificial Sequence
  Synthetic Construct
ggggaagcccactggaaaaa

SEQ ID NO: 44304 - DNA, 25 bp, Artificial Sequence
  Synthetic Construct
cctgctgtatttgcttgccttgtag

SEQ ID NO: 44305 - DNA, 21 bp, Artificial Sequence
  Synthetic Construct
ccacggagctcagagggtaag

SEQ ID NO: 44306 - DNA, 21 bp, Artificial Sequence
  Synthetic Construct
ggccagtcacgctagagtctt

SEQ ID NO: 44307 - DNA, 21 bp, Artificial Sequence
  Synthetic Construct
agagggtcacccagattggaa

SEQ ID NO: 44308 - DNA, 22 bp, Artificial Sequence
  Synthetic Construct
aacaaacactgtgcctgctaga

SEQ ID NO: 44309 - DNA, 21 bp, Artificial Sequence
  Synthetic Construct
cacacctcctgcacttcgttt

SEQ ID NO: 44310 - DNA, 20 bp, Artificial Sequence
  Synthetic Construct
gcagaggtgatgcagccatt

SEQ ID NO: 44311 - DNA, 22 bp, Artificial Sequence
  Synthetic Construct
gccctcaacgatctcgtctgtt

SEQ ID NO: 44312 - DNA, 28 bp, Artificial Sequence
  Synthetic Construct
gcctgaggaaggggaagagtaatctatg

SEQ ID NO: 44313 - DNA, 20 bp, Artificial Sequence
  Synthetic Construct
acagctgaccctgaccatgt

SEQ ID NO: 44314 - DNA, 22 bp, Artificial Sequence
  Synthetic Construct
tggagagcatgggactccttca

SEQ ID NO: 44315 - DNA, 20 bp, Artificial Sequence
  Synthetic Construct
agccagaaagcagcatgcaa

SEQ ID NO: 44316 - DNA, 26 bp, Artificial Sequence
  Synthetic Construct
ctgagcccacttatggtgactaagat

SEQ ID NO: 44317 - DNA, 22 bp, Artificial Sequence
  Synthetic Construct
cccacctcaacttgccagtctt

SEQ ID NO: 44318 - DNA, 19 bp, Artificial Sequence
  Synthetic Construct
tcctgctggtcctctgcat

SEQ ID NO: 44319 - DNA, 21 bp, Artificial Sequence
  Synthetic Construct
ccacagtgcctgtgtcacatc

SEQ ID NO: 44320 - DNA, 26 bp, Artificial Sequence
  Synthetic Construct
gttttccccaattatcctccttcact

SEQ ID NO: 44321 - DNA, 25 bp, Artificial Sequence
  Synthetic Construct
cccaggagttggagaaggtctcatt

SEQ ID NO: 44322 - DNA, 20 bp, Artificial Sequence
  Synthetic Construct
tgcacgtctggagggatgat

SEQ ID NO: 44323 - DNA, 26 bp, Artificial Sequence
  Synthetic Construct
ccaacctcactcaagccttattcagt

SEQ ID NO: 44324 - DNA, 30 bp, Artificial Sequence
  Synthetic Construct
gggcagtttctaattgtcaatagccaggaa

SEQ ID NO: 44325 - DNA, 21 bp, Artificial Sequence
  Synthetic Construct
gcctctctggcttcacagcaa

SEQ ID NO: 44326 - DNA, 22 bp, Artificial Sequence
  Synthetic Construct
ctgctggtaaacctcccctagt

SEQ ID NO: 44327 - DNA, 24 bp, Artificial Sequence
  Synthetic Construct
tgggaataaaagatctgggcttgt

SEQ ID NO: 44328 - DNA, 23 bp, Artificial Sequence
  Synthetic Construct
ccggggcttggatttctcttgtt

SEQ ID NO: 44329 - DNA, 25 bp, Artificial Sequence
  Synthetic Construct
ctgagcctttgatcctgtgtactgt

SEQ ID NO: 44330 - DNA, 19 bp, Artificial Sequence
  Synthetic Construct
tccctgagctgggcactaa

SEQ ID NO: 44331 - DNA, 25 bp, Artificial Sequence
  Synthetic Construct
caggctaactcaagacactcctaga

SEQ ID NO: 44332 - DNA, 25 bp, Artificial Sequence
  Synthetic Construct
ctgtgaagaatgccaccaggatatt

SEQ ID NO: 44333 - DNA, 21 bp, Artificial Sequence
  Synthetic Construct
cccaccatgacacagccctaa

SEQ ID NO: 44334 - DNA, 20 bp, Artificial Sequence
  Synthetic Construct
catcaacgccaggccagaaa

SEQ ID NO: 44335 - DNA, 25 bp, Artificial Sequence
  Synthetic Construct
ctttatatccaacccagacccaagt

SEQ ID NO: 44336 - DNA, 22 bp, Artificial Sequence
  Synthetic Construct
gggtgggagagctggtctataa

SEQ ID NO: 44337 - DNA, 22 bp, Artificial Sequence
  Synthetic Construct
ccctgccttgcctgtagcattt

SEQ ID NO: 44338 - DNA, 27 bp, Artificial Sequence
  Synthetic Construct
gagtattgtgactaggtgggtaaatct

SEQ ID NO: 44339 - DNA, 23 bp, Artificial Sequence
  Synthetic Construct
tgctaccaccctagtcaatgtca

SEQ ID NO: 44340 - DNA, 22 bp, Artificial Sequence
  Synthetic Construct
ctgtgggacctttagcctgtct

SEQ ID NO: 44341 - DNA, 20 bp, Artificial Sequence
  Synthetic Construct
tgccaacagtaggcctgaag

SEQ ID NO: 44342 - DNA, 23 bp, Artificial Sequence
  Synthetic Construct
ggcttgaagggtttccactgaca

SEQ ID NO: 44343 - DNA, 20 bp, Artificial Sequence
  Synthetic Construct
cgctgaagcttggggactct

SEQ ID NO: 44344 - DNA, 19 bp, Artificial Sequence
  Synthetic Construct
aggctcctgggttgtcagt

SEQ ID NO: 44345 - DNA, 22 bp, Artificial Sequence
  Synthetic Construct
ctctgcagcctcaaggtctcat

SEQ ID NO: 44346 - DNA, 20 bp, Artificial Sequence
  Synthetic Construct
tgtcactgctgctggtccat

SEQ ID NO: 44347 - DNA, 24 bp, Artificial Sequence
  Synthetic Construct
tgggaacatgtgcagaatcaaaga

SEQ ID NO: 44348 - DNA, 20 bp, Artificial Sequence
  Synthetic Construct
gcagcaagttagccctgaga

SEQ ID NO: 44349 - DNA, 23 bp, Artificial Sequence
  Synthetic Construct
gtagcaagtggtatgccttcctt

SEQ ID NO: 44350 - DNA, 22 bp, Artificial Sequence
  Synthetic Construct
ccaagtccaagtgcccttcctt

SEQ ID NO: 44351 - DNA, 26 bp, Artificial Sequence
  Synthetic Construct
ggaagcctcccacactagaataggta

SEQ ID NO: 44352 - DNA, 27 bp, Artificial Sequence
  Synthetic Construct
gaggacaaatactatgcttcggagtaa

SEQ ID NO: 44353 - DNA, 22 bp, Artificial Sequence
  Synthetic Construct
cctccccagcctcttttgacat

SEQ ID NO: 44354 - DNA, 20 bp, Artificial Sequence
  Synthetic Construct
ggtttgctgctgcgctttgt

SEQ ID NO: 44355 - DNA, 21 bp, Artificial Sequence
  Synthetic Construct
gcactgtgccagatgctatgt

SEQ ID NO: 44356 - DNA, 29 bp, Artificial Sequence
  Synthetic Construct
cccagacaaaaatgatcaggcacaatact

SEQ ID NO: 44357 - DNA, 22 bp, Artificial Sequence
  Synthetic Construct
ggaggtaggccaggtactatca

SEQ ID NO: 44358 - DNA, 24 bp, Artificial Sequence
  Synthetic Construct
ggggtcagtcgtattttctgttgt

SEQ ID NO: 44359 - DNA, 21 bp, Artificial Sequence
  Synthetic Construct
agtatcaggggccttccacaa

SEQ ID NO: 44360 - DNA, 23 bp, Artificial Sequence
  Synthetic Construct
tctcctctgccctgtaagttttc

SEQ ID NO: 44361 - DNA, 23 bp, Artificial Sequence
  Synthetic Construct
ccccaccataggagaaggtcttt

SEQ ID NO: 44362 - DNA, 22 bp, Artificial Sequence
  Synthetic Construct
gcgctcggcaagactaggaata

SEQ ID NO: 44363 - DNA, 21 bp, Artificial Sequence
  Synthetic Construct
aatggcacctttttgctgcat

SEQ ID NO: 44364 - DNA, 23 bp, Artificial Sequence
  Synthetic Construct
ttgtccaggtaaagctgctcaat

SEQ ID NO: 44365 - DNA, 26 bp, Artificial Sequence
  Synthetic Construct
ccaaaatctctcttggcacccatgtt

SEQ ID NO: 44366 - DNA, 25 bp, Artificial Sequence
  Synthetic Construct
gccgatccgtctatcaacctgtttc

SEQ ID NO: 44367 - DNA, 24 bp, Artificial Sequence
  Synthetic Construct
caagcaattcttcaccaacacctt

SEQ ID NO: 44368 - DNA, 22 bp, Artificial Sequence
  Synthetic Construct
ccctggtgcatggatcacagtt

SEQ ID NO: 44369 - DNA, 24 bp, Artificial Sequence
  Synthetic Construct
cagttgcaaccatgtttcctctca

SEQ ID NO: 44370 - DNA, 22 bp, Artificial Sequence
  Synthetic Construct
gaaggaacctgtctggtgatgt

SEQ ID NO: 44371 - DNA, 25 bp, Artificial Sequence
  Synthetic Construct
cccaaggtaaaagcaattcttgtgt

SEQ ID NO: 44372 - DNA, 22 bp, Artificial Sequence
  Synthetic Construct
actgggcttcaaagacccaaag

SEQ ID NO: 44373 - DNA, 23 bp, Artificial Sequence
  Synthetic Construct
aaggagaactgactctcccagat

SEQ ID NO: 44374 - DNA, 22 bp, Artificial Sequence
  Synthetic Construct
ggctcgtcagtctcttctctgt

SEQ ID NO: 44375 - DNA, 20 bp, Artificial Sequence
  Synthetic Construct
ccactgtgcctggcctcaat

SEQ ID NO: 44376 - DNA, 25 bp, Artificial Sequence
  Synthetic Construct
ggttcttggtatggaatcctagtgt

SEQ ID NO: 44377 - DNA, 24 bp, Artificial Sequence
  Synthetic Construct
cccataagtggatttcctgtgaga

SEQ ID NO: 44378 - DNA, 22 bp, Artificial Sequence
  Synthetic Construct
acaaacagcaatgctccagcta

SEQ ID NO: 44379 - DNA, 24 bp, Artificial Sequence
  Synthetic Construct
gccctttgaaataaggcagagtca

SEQ ID NO: 44380 - DNA, 21 bp, Artificial Sequence
  Synthetic Construct
tccataggcttgctggactca

SEQ ID NO: 44381 - DNA, 20 bp, Artificial Sequence
  Synthetic Construct
gacaccacacacctgcgaaa

SEQ ID NO: 44382 - DNA, 24 bp, Artificial Sequence
  Synthetic Construct
aggtcacactctagacctgtcatt

SEQ ID NO: 44383 - DNA, 22 bp, Artificial Sequence
  Synthetic Construct
gggttggcttggcatcctttga

SEQ ID NO: 44384 - DNA, 20 bp, Artificial Sequence
  Synthetic Construct
agcagctttgtggcctggta

SEQ ID NO: 44385 - DNA, 27 bp, Artificial Sequence
  Synthetic Construct
gaaatacagtggaaccacaatgaccta

SEQ ID NO: 44386 - DNA, 22 bp, Artificial Sequence
  Synthetic Construct
ggcacgaatcattccagcttca

SEQ ID NO: 44387 - DNA, 23 bp, Artificial Sequence
  Synthetic Construct
ggcagctgcactacaaagtgtct

SEQ ID NO: 44388 - DNA, 26 bp, Artificial Sequence
  Synthetic Construct
gagtctgtatctgaaagtaccccatt

SEQ ID NO: 44389 - DNA, 23 bp, Artificial Sequence
  Synthetic Construct
ggaccccatcctgtggtcatttc

SEQ ID NO: 44390 - DNA, 24 bp, Artificial Sequence
  Synthetic Construct
cctccctgtagctttgaggtggtt

SEQ ID NO: 44391 - DNA, 23 bp, Artificial Sequence
  Synthetic Construct
gctaagagaagccgtttggcata

SEQ ID NO: 44392 - DNA, 20 bp, Artificial Sequence
  Synthetic Construct
agggaggtgccatgagttga

SEQ ID NO: 44393 - DNA, 23 bp, Artificial Sequence
  Synthetic Construct
gccctgaataactggcagcaatg

SEQ ID NO: 44394 - DNA, 22 bp, Artificial Sequence
  Synthetic Construct
gctgaactcccgctttccttgt

SEQ ID NO: 44395 - DNA, 23 bp, Artificial Sequence
  Synthetic Construct
ggacttcattggtcctgggtgta

SEQ ID NO: 44396 - DNA, 20 bp, Artificial Sequence
  Synthetic Construct
actctgcaggaggcacaaac

SEQ ID NO: 44397 - DNA, 25 bp, Artificial Sequence
  Synthetic Construct
acttactgtgtacttgtgcttggat

SEQ ID NO: 44398 - DNA, 25 bp, Artificial Sequence
  Synthetic Construct
ggtgaccctcttgggagttaagagt

SEQ ID NO: 44399 - DNA, 22 bp, Artificial Sequence
  Synthetic Construct
gtggaaatacccagagcacaca

SEQ ID NO: 44400 - DNA, 24 bp, Artificial Sequence
  Synthetic Construct
gcagcacgtatatctcaccgatgt

SEQ ID NO: 44401 - DNA, 23 bp, Artificial Sequence
  Synthetic Construct
ggcagggctaatttgacacaatg

SEQ ID NO: 44402 - DNA, 25 bp, Artificial Sequence
  Synthetic Construct
gaggaaaaaggtacagagtgagtga

SEQ ID NO: 44403 - DNA, 20 bp, Artificial Sequence
  Synthetic Construct
acacaacgtcctgcccaaag

SEQ ID NO: 44404 - DNA, 20 bp, Artificial Sequence
  Synthetic Construct
ttcctccagaggcctgagtt

SEQ ID NO: 44405 - DNA, 19 bp, Artificial Sequence
  Synthetic Construct
cctgtgggcccagacttca

SEQ ID NO: 44406 - DNA, 20 bp, Artificial Sequence
  Synthetic Construct
agccagctgccattttgaga

SEQ ID NO: 44407 - DNA, 22 bp, Artificial Sequence
  Synthetic Construct
cctgaaagcccacccacacaat

SEQ ID NO: 44408 - DNA, 25 bp, Artificial Sequence
  Synthetic Construct
gggtagttcaagggacttctgtttc

SEQ ID NO: 44409 - DNA, 23 bp, Artificial Sequence
  Synthetic Construct
gcttcagcagtggctaagaatga

SEQ ID NO: 44410 - DNA, 24 bp, Artificial Sequence
  Synthetic Construct
ggtcgctgtctcatagggtctgta

SEQ ID NO: 44411 - DNA, 22 bp, Artificial Sequence
  Synthetic Construct
gggagctatgcaggatgcactt

SEQ ID NO: 44412 - DNA, 20 bp, Artificial Sequence
  Synthetic Construct
agcccacccactctcactta

SEQ ID NO: 44413 - DNA, 23 bp, Artificial Sequence
  Synthetic Construct
cgccttgaagttagatgcactgt

SEQ ID NO: 44414 - DNA, 20 bp, Artificial Sequence
  Synthetic Construct
aactgctatgcgggcagtga

SEQ ID NO: 44415 - DNA, 26 bp, Artificial Sequence
  Synthetic Construct
gcagctagagaggtgagggtgaaatc

SEQ ID NO: 44416 - DNA, 28 bp, Artificial Sequence
  Synthetic Construct
cccttgttccttatctcacagacccaaa

SEQ ID NO: 44417 - DNA, 21 bp, Artificial Sequence
  Synthetic Construct
tccccaattgacctcctggat

SEQ ID NO: 44418 - DNA, 19 bp, Artificial Sequence
  Synthetic Construct
gtggcatgggaggggtagt

SEQ ID NO: 44419 - DNA, 24 bp, Artificial Sequence
  Synthetic Construct
gcatctgggaaagaagtggtggtt

SEQ ID NO: 44420 - DNA, 22 bp, Artificial Sequence
  Synthetic Construct
atgtcagaggtctccacagcta

SEQ ID NO: 44421 - DNA, 22 bp, Artificial Sequence
  Synthetic Construct
acctaacagagctggacagttg

SEQ ID NO: 44422 - DNA, 19 bp, Artificial Sequence
  Synthetic Construct
agagcttggggcagactga

SEQ ID NO: 44423 - DNA, 22 bp, Artificial Sequence
  Synthetic Construct
cccaccttgccacatgacaaca

SEQ ID NO: 44424 - DNA, 20 bp, Artificial Sequence
  Synthetic Construct
tgtaacgtgggtccctgact

SEQ ID NO: 44425 - DNA, 22 bp, Artificial Sequence
  Synthetic Construct
cctggtttgggtcacctggttt

SEQ ID NO: 44426 - DNA, 23 bp, Artificial Sequence
  Synthetic Construct
caccaaacctagcatggaacaca

SEQ ID NO: 44427 - DNA, 24 bp, Artificial Sequence
  Synthetic Construct
ccaaggctaacaattccgctcttc

SEQ ID NO: 44428 - DNA, 22 bp, Artificial Sequence
  Synthetic Construct
agggccttgatggtccttgtag

SEQ ID NO: 44429 - DNA, 27 bp, Artificial Sequence
  Synthetic Construct
ggtttatttaaagccccagaggacttc

SEQ ID NO: 44430 - DNA, 27 bp, Artificial Sequence
  Synthetic Construct
gtatagtattgtacctggccctcatag

SEQ ID NO: 44431 - DNA, 19 bp, Artificial Sequence
  Synthetic Construct
taggtggctggctgcgtat

SEQ ID NO: 44432 - DNA, 21 bp, Artificial Sequence
  Synthetic Construct
aggggcttggatcctggcaaa

SEQ ID NO: 44433 - DNA, 22 bp, Artificial Sequence
  Synthetic Construct
cggagatctctggggcacaaaa

SEQ ID NO: 44434 - DNA, 27 bp, Artificial Sequence
  Synthetic Construct
cacaaagatgccttatggatggagttc

SEQ ID NO: 44435 - DNA, 18 bp, Artificial Sequence
  Synthetic Construct
acacgccccggtttttca

SEQ ID NO: 44436 - DNA, 20 bp, Artificial Sequence
  Synthetic Construct
acaagccagagacccagaca

SEQ ID NO: 44437 - DNA, 24 bp, Artificial Sequence
  Synthetic Construct
ggcaacctttgacagcctcaaaat

SEQ ID NO: 44438 - DNA, 19 bp, Artificial Sequence
  Synthetic Construct
aactgagtgcgtgctccaa

SEQ ID NO: 44439 - DNA, 20 bp, Artificial Sequence
  Synthetic Construct
cctgagcacgtgtgcaatct

SEQ ID NO: 44440 - DNA, 22 bp, Artificial Sequence
  Synthetic Construct
gcttcccaagcatgggttcaag

SEQ ID NO: 44441 - DNA, 21 bp, Artificial Sequence
  Synthetic Construct
gcccctggttcctgtttgttt

SEQ ID NO: 44442 - DNA, 24 bp, Artificial Sequence
  Synthetic Construct
accaattcggtacagtgagtttct

SEQ ID NO: 44443 - DNA, 21 bp, Artificial Sequence
  Synthetic Construct
tggccacagcagcactaattc

SEQ ID NO: 44444 - DNA, 25 bp, Artificial Sequence
  Synthetic Construct
gactgacttagtccagggaaagcat

SEQ ID NO: 44445 - DNA, 24 bp, Artificial Sequence
  Synthetic Construct
gacttttcaaaacccatcccacaa

SEQ ID NO: 44446 - DNA, 22 bp, Artificial Sequence
  Synthetic Construct
gacttttccgactgtccagctt

SEQ ID NO: 44447 - DNA, 22 bp, Artificial Sequence
  Synthetic Construct
gtcacgcttggagcatcttttc

SEQ ID NO: 44448 - DNA, 20 bp, Artificial Sequence
  Synthetic Construct
gcaacctgacagcagctcta

SEQ ID NO: 44449 - DNA, 23 bp, Artificial Sequence
  Synthetic Construct
aaaagcaagacccaactgtgttc

SEQ ID NO: 44450 - DNA, 22 bp, Artificial Sequence
  Synthetic Construct
ctgcagtgggtagctcctttct

SEQ ID NO: 44451 - DNA, 20 bp, Artificial Sequence
  Synthetic Construct
tccccttggagtagcaggtt

SEQ ID NO: 44452 - DNA, 28 bp, Artificial Sequence
  Synthetic Construct
cacctctaatagaagactggaacaggta

SEQ ID NO: 44453 - DNA, 21 bp, Artificial Sequence
  Synthetic Construct
gtcaggactgcaacacactct

SEQ ID NO: 44454 - DNA, 19 bp, Artificial Sequence
  Synthetic Construct
tcaggctgccacagtcagt

SEQ ID NO: 44455 - DNA, 28 bp, Artificial Sequence
  Synthetic Construct
ggtactatttctctcatagccaggattc

SEQ ID NO: 44456 - DNA, 23 bp, Artificial Sequence
  Synthetic Construct
ctgctatgacagtgcaggattga

SEQ ID NO: 44457 - DNA, 26 bp, Artificial Sequence
  Synthetic Construct
gggttagttttcatgcagcaggtatg

SEQ ID NO: 44458 - DNA, 30 bp, Artificial Sequence
  Synthetic Construct
gtctgccaattaagacaaatggctttgcat

SEQ ID NO: 44459 - DNA, 25 bp, Artificial Sequence
  Synthetic Construct
ggcagaaaaacaccaacgggaaatc

SEQ ID NO: 44460 - DNA, 19 bp, Artificial Sequence
  Synthetic Construct
tctcgctccaggcttgctt

SEQ ID NO: 44461 - DNA, 27 bp, Artificial Sequence
  Synthetic Construct
cactcaaagtagcttggaaaggcagta

SEQ ID NO: 44462 - DNA, 24 bp, Artificial Sequence
  Synthetic Construct
gcgtaagtccaatggccatgaaag

SEQ ID NO: 44463 - DNA, 22 bp, Artificial Sequence
  Synthetic Construct
ccctagtttgggccgtgtgttt

SEQ ID NO: 44464 - DNA, 25 bp, Artificial Sequence
  Synthetic Construct
ggggtgagtaagggacttattgtag

SEQ ID NO: 44465 - DNA, 21 bp, Artificial Sequence
  Synthetic Construct
ataggcccagtggccaggata

SEQ ID NO: 44466 - DNA, 24 bp, Artificial Sequence
  Synthetic Construct
gtgcagcaagaatgtgatgaggaa

SEQ ID NO: 44467 - DNA, 24 bp, Artificial Sequence
  Synthetic Construct
gagggttggttggaagggattaag

SEQ ID NO: 44468 - DNA, 22 bp, Artificial Sequence
  Synthetic Construct
ggcttctcctacatggcagaca

SEQ ID NO: 44469 - DNA, 23 bp, Artificial Sequence
  Synthetic Construct
ggtctccagatctccctcagcta

SEQ ID NO: 44470 - DNA, 21 bp, Artificial Sequence
  Synthetic Construct
tgccaaactggccctccaaag

SEQ ID NO: 44471 - DNA, 18 bp, Artificial Sequence
  Synthetic Construct
gttgccagccagcaccat

SEQ ID NO: 44472 - DNA, 27 bp, Artificial Sequence
  Synthetic Construct
gctgatgaagtcatggaatcctcttct

SEQ ID NO: 44473 - DNA, 22 bp, Artificial Sequence
  Synthetic Construct
gcttgcaccacaactccaccaa

SEQ ID NO: 44474 - DNA, 26 bp, Artificial Sequence
  Synthetic Construct
gtagttttgttagaaccgtggtcttc

SEQ ID NO: 44475 - DNA, 27 bp, Artificial Sequence
  Synthetic Construct
ggtggtctgaatattaagcaagagttg

SEQ ID NO: 44476 - DNA, 20 bp, Artificial Sequence
  Synthetic Construct
cccacagtgccccactaaca

SEQ ID NO: 44477 - DNA, 22 bp, Artificial Sequence
  Synthetic Construct
ggccttttgactccttggcttt

SEQ ID NO: 44478 - DNA, 19 bp, Artificial Sequence
  Synthetic Construct
ctggccagccgtgcataat

SEQ ID NO: 44479 - DNA, 22 bp, Artificial Sequence
  Synthetic Construct
ccttctgccctcctgtatctca

SEQ ID NO: 44480 - DNA, 22 bp, Artificial Sequence
  Synthetic Construct
cgacatccttcaccatgccatt

SEQ ID NO: 44481 - DNA, 22 bp, Artificial Sequence
  Synthetic Construct
tgaagcagacatgaagctcact

SEQ ID NO: 44482 - DNA, 24 bp, Artificial Sequence
  Synthetic Construct
acacatacgcacagctaacatact

SEQ ID NO: 44483 - DNA, 22 bp, Artificial Sequence
  Synthetic Construct
gtactgaccttgcagagccttt

SEQ ID NO: 44484 - DNA, 22 bp, Artificial Sequence
  Synthetic Construct
gctggaggtgttgtggtgaatc

SEQ ID NO: 44485 - DNA, 21 bp, Artificial Sequence
  Synthetic Construct
ccctggctttgggttggtgat

SEQ ID NO: 44486 - DNA, 23 bp, Artificial Sequence
  Synthetic Construct
ccagcctcttctagcaccctact

SEQ ID NO: 44487 - DNA, 22 bp, Artificial Sequence
  Synthetic Construct
cacagagcagtctacacacaca

SEQ ID NO: 44488 - DNA, 22 bp, Artificial Sequence
  Synthetic Construct
gggtggaggcacatactgtact

SEQ ID NO: 44489 - DNA, 23 bp, Artificial Sequence
  Synthetic Construct
ggcactgcttcctaatccacgat

SEQ ID NO: 44490 - DNA, 24 bp, Artificial Sequence
  Synthetic Construct
ccttgacctttgcaattccctgaa

SEQ ID NO: 44491 - DNA, 20 bp, Artificial Sequence
  Synthetic Construct
tgtcccctcgggtacacaat

SEQ ID NO: 44492 - DNA, 19 bp, Artificial Sequence
  Synthetic Construct
ggctacaggcctggcactt

SEQ ID NO: 44493 - DNA, 25 bp, Artificial Sequence
  Synthetic Construct
ggtttcaagcctcactggtatgtct

SEQ ID NO: 44494 - DNA, 20 bp, Artificial Sequence
  Synthetic Construct
gaaggacagtgcacccaagt

SEQ ID NO: 44495 - DNA, 21 bp, Artificial Sequence
  Synthetic Construct
gggctaaggctccctacacat

SEQ ID NO: 44496 - DNA, 24 bp, Artificial Sequence
  Synthetic Construct
cctgttagctttgctcctgcacaa

SEQ ID NO: 44497 - DNA, 24 bp, Artificial Sequence
  Synthetic Construct
ccttggatcactgaacacctcctt

SEQ ID NO: 44498 - DNA, 25 bp, Artificial Sequence
  Synthetic Construct
gcctgtaagactttaacccagtttg

SEQ ID NO: 44499 - DNA, 25 bp, Artificial Sequence
  Synthetic Construct
gcacctctgtggttattccgtgttc

SEQ ID NO: 44500 - DNA, 20 bp, Artificial Sequence
  Synthetic Construct
ccggataggcagtggcagaa

SEQ ID NO: 44501 - DNA, 30 bp, Artificial Sequence
  Synthetic Construct
ctgcaaactctttcttctcctctaagaaac

SEQ ID NO: 44502 - DNA, 20 bp, Artificial Sequence
  Synthetic Construct
agccgtacgctaggttgtgt

SEQ ID NO: 44503 - DNA, 24 bp, Artificial Sequence
  Synthetic Construct
gtatccagattgcccatagcttgt

SEQ ID NO: 44504 - DNA, 25 bp, Artificial Sequence
  Synthetic Construct
gaggatcaggaaccctaagctttac

SEQ ID NO: 44505 - DNA, 23 bp, Artificial Sequence
  Synthetic Construct
agttacccacactggaaccaaag

SEQ ID NO: 44506 - DNA, 24 bp, Artificial Sequence
  Synthetic Construct
agaatcttgtgggctgagtaacaa

SEQ ID NO: 44507 - DNA, 27 bp, Artificial Sequence
  Synthetic Construct
ccctctgtataggtttccctgtagctt

SEQ ID NO: 44508 - DNA, 28 bp, Artificial Sequence
  Synthetic Construct
gctaggctatgtaagtaggtggagaatg

SEQ ID NO: 44509 - DNA, 27 bp, Artificial Sequence
  Synthetic Construct
gcccctgtattctaaccagtgggattg

SEQ ID NO: 44510 - DNA, 19 bp, Artificial Sequence
  Synthetic Construct
agagcacagggaccacaga

SEQ ID NO: 44511 - DNA, 20 bp, Artificial Sequence
  Synthetic Construct
cagcttccccttctgtgcaa

SEQ ID NO: 44512 - DNA, 22 bp, Artificial Sequence
  Synthetic Construct
aggacctttctggcatgtgttg

SEQ ID NO: 44513 - DNA, 22 bp, Artificial Sequence
  Synthetic Construct
gccacaaccctaccaactgaga

SEQ ID NO: 44514 - DNA, 20 bp, Artificial Sequence
  Synthetic Construct
aaggtttctgcccaggcttt

SEQ ID NO: 44515 - DNA, 27 bp, Artificial Sequence
  Synthetic Construct
gcaaaagtactcgcattgtgaaagcta

SEQ ID NO: 44516 - DNA, 23 bp, Artificial Sequence
  Synthetic Construct
cctctgccccagcatatatcaaa

SEQ ID NO: 44517 - DNA, 22 bp, Artificial Sequence
  Synthetic Construct
cacacccaagaacccactggaa

SEQ ID NO: 44518 - DNA, 22 bp, Artificial Sequence
  Synthetic Construct
gcccagaggcttgacatgatct

SEQ ID NO: 44519 - DNA, 24 bp, Artificial Sequence
  Synthetic Construct
gtcattgcctcaaagggagcttag

SEQ ID NO: 44520 - DNA, 22 bp, Artificial Sequence
  Synthetic Construct
ctagcctctctcagccacattc

SEQ ID NO: 44521 - DNA, 22 bp, Artificial Sequence
  Synthetic Construct
gctcacagtgtgtgtgggcttt

SEQ ID NO: 44522 - DNA, 23 bp, Artificial Sequence
  Synthetic Construct
cctacttttgggaggggaagtga

SEQ ID NO: 44523 - DNA, 23 bp, Artificial Sequence
  Synthetic Construct
gccccttgattcctctaaaccat

SEQ ID NO: 44524 - DNA, 24 bp, Artificial Sequence
  Synthetic Construct
gagccctgaaatcagcttctctct

SEQ ID NO: 44525 - DNA, 26 bp, Artificial Sequence
  Synthetic Construct
ggtggttcagtgtattgtggtagaag

SEQ ID NO: 44526 - DNA, 21 bp, Artificial Sequence
  Synthetic Construct
ggcctgtgcctagcttcaaga

SEQ ID NO: 44527 - DNA, 20 bp, Artificial Sequence
  Synthetic Construct
aacgggcagcaggtggctta

SEQ ID NO: 44528 - DNA, 20 bp, Artificial Sequence
  Synthetic Construct
gaggcaagcctgagtgttct

SEQ ID NO: 44529 - DNA, 22 bp, Artificial Sequence
  Synthetic Construct
tcacccatcagagggctagtgt

SEQ ID NO: 44530 - DNA, 22 bp, Artificial Sequence
  Synthetic Construct
tcccagcttgtctctgggctta

SEQ ID NO: 44531 - DNA, 27 bp, Artificial Sequence
  Synthetic Construct
cagattctgactcacagtggacttgtt

SEQ ID NO: 44532 - DNA, 22 bp, Artificial Sequence
  Synthetic Construct
cctgccaccttgattgctccat

SEQ ID NO: 44533 - DNA, 27 bp, Artificial Sequence
  Synthetic Construct
ccacatacattaccgtctgcttatttg

SEQ ID NO: 44534 - DNA, 23 bp, Artificial Sequence
  Synthetic Construct
cgaacccaagcagtcttctgtct

SEQ ID NO: 44535 - DNA, 23 bp, Artificial Sequence
  Synthetic Construct
gctaggacatccaccagcattca

SEQ ID NO: 44536 - DNA, 22 bp, Artificial Sequence
  Synthetic Construct
ctgtgtttgccatggacacctt

SEQ ID NO: 44537 - DNA, 22 bp, Artificial Sequence
  Synthetic Construct
gccctcaatcacccttgagaca

SEQ ID NO: 44538 - DNA, 23 bp, Artificial Sequence
  Synthetic Construct
gctggctgaatagggacatggaa

SEQ ID NO: 44539 - DNA, 21 bp, Artificial Sequence
  Synthetic Construct
tccttccatgggccagtgtca

SEQ ID NO: 44540 - DNA, 26 bp, Artificial Sequence
  Synthetic Construct
cacaaacttaaggtaaaggggtggaa

SEQ ID NO: 44541 - DNA, 25 bp, Artificial Sequence
  Synthetic Construct
agagtttccttctaacaccccttct

SEQ ID NO: 44542 - DNA, 25 bp, Artificial Sequence
  Synthetic Construct
ggaaatgatccaccatgagtgaaga

SEQ ID NO: 44543 - DNA, 22 bp, Artificial Sequence
  Synthetic Construct
tttggacaggtggaaccaaaga

SEQ ID NO: 44544 - DNA, 21 bp, Artificial Sequence
  Synthetic Construct
ccagaccaaagctgccaccta

SEQ ID NO: 44545 - DNA, 22 bp, Artificial Sequence
  Synthetic Construct
ggagagggaagagtggggacat

SEQ ID NO: 44546 - DNA, 26 bp, Artificial Sequence
  Synthetic Construct
gacgtctaaattgttcttgccacttg

SEQ ID NO: 44547 - DNA, 22 bp, Artificial Sequence
  Synthetic Construct
tccttttccttggtgcctttct

SEQ ID NO: 44548 - DNA, 27 bp, Artificial Sequence
  Synthetic Construct
ctatttcacctggaccatttagactca

SEQ ID NO: 44549 - DNA, 22 bp, Artificial Sequence
  Synthetic Construct
gccccacccgtgtattatgact

SEQ ID NO: 44550 - DNA, 21 bp, Artificial Sequence
  Synthetic Construct
acgaagccttggggaggtaac

SEQ ID NO: 44551 - DNA, 19 bp, Artificial Sequence
  Synthetic Construct
agggctggcaccctaccaa

SEQ ID NO: 44552 - DNA, 20 bp, Artificial Sequence
  Synthetic Construct
tggctatgacgttgctgtgt

SEQ ID NO: 44553 - DNA, 23 bp, Artificial Sequence
  Synthetic Construct
ggctatctgccactggatagcat

SEQ ID NO: 44554 - DNA, 22 bp, Artificial Sequence
  Synthetic Construct
cctgacctaccgcttccataac

SEQ ID NO: 44555 - DNA, 25 bp, Artificial Sequence
  Synthetic Construct
tgacactttgttgtcccctctattc

SEQ ID NO: 44556 - DNA, 21 bp, Artificial Sequence
  Synthetic Construct
ggacaaagctcatgccgaaca

SEQ ID NO: 44557 - DNA, 20 bp, Artificial Sequence
  Synthetic Construct
cagttgcctgaggggaggta

SEQ ID NO: 44558 - DNA, 23 bp, Artificial Sequence
  Synthetic Construct
tttcctcatttcccaggcttgaa

SEQ ID NO: 44559 - DNA, 24 bp, Artificial Sequence
  Synthetic Construct
gggaactttggggcatctaacaac

SEQ ID NO: 44560 - DNA, 22 bp, Artificial Sequence
  Synthetic Construct
acctgagctgagagccatcaca

SEQ ID NO: 44561 - DNA, 22 bp, Artificial Sequence
  Synthetic Construct
tggtaggcagaatccacccatt

SEQ ID NO: 44562 - DNA, 23 bp, Artificial Sequence
  Synthetic Construct
cgacatcctcacgatggcagtag

SEQ ID NO: 44563 - DNA, 28 bp, Artificial Sequence
  Synthetic Construct
ccccagctattaactacttggctacaga

SEQ ID NO: 44564 - DNA, 21 bp, Artificial Sequence
  Synthetic Construct
aggtggagcaactcaaagcaa

SEQ ID NO: 44565 - DNA, 20 bp, Artificial Sequence
  Synthetic Construct
gccaccactgaggaacacat

SEQ ID NO: 44566 - DNA, 23 bp, Artificial Sequence
  Synthetic Construct
ggccaatgtcctcactagacctt

SEQ ID NO: 44567 - DNA, 24 bp, Artificial Sequence
  Synthetic Construct
gtgacaaagccatccttgcttgta

SEQ ID NO: 44568 - DNA, 20 bp, Artificial Sequence
  Synthetic Construct
tctccaccagctgagtcaca

SEQ ID NO: 44569 - DNA, 25 bp, Artificial Sequence
  Synthetic Construct
gaaaagttgtttaaccctgctgaca

SEQ ID NO: 44570 - DNA, 22 bp, Artificial Sequence
  Synthetic Construct
tccaagcctccattgtctctct

SEQ ID NO: 44571 - DNA, 22 bp, Artificial Sequence
  Synthetic Construct
gaactaactcaaggccggagaa

SEQ ID NO: 44572 - DNA, 24 bp, Artificial Sequence
  Synthetic Construct
cctcatatgccaccaattcctttg

SEQ ID NO: 44573 - DNA, 25 bp, Artificial Sequence
  Synthetic Construct
ccacctaatttgctccattccatgt

SEQ ID NO: 44574 - DNA, 27 bp, Artificial Sequence
  Synthetic Construct
gtggagtagacagcaaatgagtaggaa

SEQ ID NO: 44575 - DNA, 21 bp, Artificial Sequence
  Synthetic Construct
gtgcagtaagccccattcagt

SEQ ID NO: 44576 - DNA, 27 bp, Artificial Sequence
  Synthetic Construct
cacctatataatcggcacagagtggtt

SEQ ID NO: 44577 - DNA, 25 bp, Artificial Sequence
  Synthetic Construct
catgtttccaaacacatgcatcaga

SEQ ID NO: 44578 - DNA, 21 bp, Artificial Sequence
  Synthetic Construct
gggagtggcatggaagaatca

SEQ ID NO: 44579 - DNA, 23 bp, Artificial Sequence
  Synthetic Construct
caggcttcccaaccttctcatag

SEQ ID NO: 44580 - DNA, 20 bp, Artificial Sequence
  Synthetic Construct
acccgtggcatctgctctta

SEQ ID NO: 44581 - DNA, 24 bp, Artificial Sequence
  Synthetic Construct
cagcaaagagacgtttgtggaatg

SEQ ID NO: 44582 - DNA, 26 bp, Artificial Sequence
  Synthetic Construct
gcccttatctcaatgatccccacctt

SEQ ID NO: 44583 - DNA, 24 bp, Artificial Sequence
  Synthetic Construct
accccagtgttgctctatacattg

SEQ ID NO: 44584 - DNA, 22 bp, Artificial Sequence
  Synthetic Construct
ctgggtaccgagtatgggatca

SEQ ID NO: 44585 - DNA, 24 bp, Artificial Sequence
  Synthetic Construct
ccagaaaaggcaaaccctacattc

SEQ ID NO: 44586 - DNA, 22 bp, Artificial Sequence
  Synthetic Construct
agcagtgaggccagaaacttag

SEQ ID NO: 44587 - DNA, 23 bp, Artificial Sequence
  Synthetic Construct
tggattccaaactttgcgtgcta

SEQ ID NO: 44588 - DNA, 22 bp, Artificial Sequence
  Synthetic Construct
tggtctgtgggttgggaagact

SEQ ID NO: 44589 - DNA, 20 bp, Artificial Sequence
  Synthetic Construct
ggcttccaagtggtggcaat

SEQ ID NO: 44590 - DNA, 19 bp, Artificial Sequence
  Synthetic Construct
aggcaggggtggtcactca

SEQ ID NO: 44591 - DNA, 18 bp, Artificial Sequence
  Synthetic Construct
tcgccactgccacacact

SEQ ID NO: 44592 - DNA, 24 bp, Artificial Sequence
  Synthetic Construct
agtagaagatcagcttcccactct

SEQ ID NO: 44593 - DNA, 24 bp, Artificial Sequence
  Synthetic Construct
gcctatagtgaacaccaccgtaga

SEQ ID NO: 44594 - DNA, 25 bp, Artificial Sequence
  Synthetic Construct
ccatgtccattgctaggtgctattg

SEQ ID NO: 44595 - DNA, 22 bp, Artificial Sequence
  Synthetic Construct
cgacggaacagaacctctcctt

SEQ ID NO: 44596 - DNA, 21 bp, Artificial Sequence
  Synthetic Construct
gctcactgcagcttgctctct

SEQ ID NO: 44597 - DNA, 30 bp, Artificial Sequence
  Synthetic Construct
gccaatagctaatgctacaagtagctcaaa

SEQ ID NO: 44598 - DNA, 24 bp, Artificial Sequence
  Synthetic Construct
ttctccatagacgtgaccatcaac

SEQ ID NO: 44599 - DNA, 21 bp, Artificial Sequence
  Synthetic Construct
gcagctggagtttccgtcaca

SEQ ID NO: 44600 - DNA, 23 bp, Artificial Sequence
  Synthetic Construct
cctcagccaagggagggagttat

SEQ ID NO: 44601 - DNA, 26 bp, Artificial Sequence
  Synthetic Construct
gcaaaatcttagagaagctgggttga

SEQ ID NO: 44602 - DNA, 29 bp, Artificial Sequence
  Synthetic Construct
ggtgtccatgtactagaaggagagttatc

SEQ ID NO: 44603 - DNA, 23 bp, Artificial Sequence
  Synthetic Construct
gctgtttttgaagctggcaaagt

SEQ ID NO: 44604 - DNA, 20 bp, Artificial Sequence
  Synthetic Construct
tgctcacgtgtgtcctggaa

SEQ ID NO: 44605 - DNA, 24 bp, Artificial Sequence
  Synthetic Construct
gccccatctgagagacagcaattc

SEQ ID NO: 44606 - DNA, 21 bp, Artificial Sequence
  Synthetic Construct
tagggcggcagggttggacta

SEQ ID NO: 44607 - DNA, 22 bp, Artificial Sequence
  Synthetic Construct
ccagggtggtttctccctgaaa

SEQ ID NO: 44608 - DNA, 20 bp, Artificial Sequence
  Synthetic Construct
atcacctctccctgcacctt

SEQ ID NO: 44609 - DNA, 24 bp, Artificial Sequence
  Synthetic Construct
caactaagatggaccccaggattg

SEQ ID NO: 44610 - DNA, 20 bp, Artificial Sequence
  Synthetic Construct
cctgtgcctgccttccgaat

SEQ ID NO: 44611 - DNA, 42 bp, Artificial Sequence
  Synthetic Construct
aactcacatagcacacgacgctcttccgatcttgcaagcaca

SEQ ID NO: 44612 - DNA, 39 bp, Artificial Sequence
  Synthetic Construct
tcctctgtgacacgacgctcttccgatctccctgctctt

SEQ ID NO: 44613 - DNA, 40 bp, Artificial Sequence
  Synthetic Construct
tcctctctctacacgacgctcttccgatctcgggctgtca

SEQ ID NO: 44614 - DNA, 42 bp, Artificial Sequence
  Synthetic Construct
tacatccttgagacacgacgctcttccgatctgctgtgcagt

SEQ ID NO: 44615 - DNA, 42 bp, Artificial Sequence
  Synthetic Construct
tttgcttgagctacacgacgctcttccgatctcgggagtttc

SEQ ID NO: 44616 - DNA, 42 bp, Artificial Sequence
  Synthetic Construct
gtcttatggtggacacgacgctcttccgatctcaaagccagt

SEQ ID NO: 44617 - DNA, 50 bp, Artificial Sequence
  Synthetic Construct
aactcacatagctgatcggtacacgacgctcttccgatcttgcaagcaca

SEQ ID NO: 44618 - DNA, 47 bp, Artificial Sequence
  Synthetic Construct
tcctctgtgtgatcggtacacgacgctcttccgatctccctgctctt

SEQ ID NO: 44619 - DNA, 48 bp, Artificial Sequence
  Synthetic Construct
tcctctctcttgatcggtacacgacgctcttccgatctcgggctgtca

SEQ ID NO: 44620 - DNA, 50 bp, Artificial Sequence
  Synthetic Construct
tacatccttgagtgatcggtacacgacgctcttccgatctgctgtgcagt

SEQ ID NO: 44621 - DNA, 50 bp, Artificial Sequence
  Synthetic Construct
tttgcttgagcttgatcggtacacgacgctcttccgatctcgggagtttc

SEQ ID NO: 44622 - DNA, 50 bp, Artificial Sequence
  Synthetic Construct
gtcttatggtggtgatcggtacacgacgctcttccgatctcaaagccagt

SEQ ID NO: 44623 - DNA, 13 bp, Artificial Sequence
  Synthetic Construct
  modified_base (3)..(3): a, c, t, g, unknown or other
  modified_base (6)..(6): a, c, t, g, unknown or other
  modified_base (8)..(9): a, c, t, g, unknown or other
  modified_base (12)..(12): a, c, t, g, unknown or other
ccnccntnnccnc

SEQ ID NO: 44624 - DNA, 16 bp, Artificial Sequence
  Synthetic Construct
cgtgacgtgacggact

SEQ ID NO: 44625 - DNA, 46 bp, Artificial Sequence
  Description of Artificial Sequence: Synthetic oligonucleotide
tcctctcttgatcggtacacgacgctcttccgatctcgggctgtca
